United States Patent 8,183,436 (NUCLEOTIDE SEQUENCES AND POLYPEPTIDES ENCODED THEREBY USEFUL FOR MODIFYING PLANT CHARACTERISTICS) - sequence listing, part 4

SEQ ID NO: 5013 - DNA, 1060 bp, Zea mays
  misc_feature (1)..(1060): Ceres cDNA ID no. 22005514
  misc_feature (1)..(1060): Ceres CLONE  ID no. 506010
  misc_feature (1)..(1060): Also known as  Ceres CDNA ID no. 23786472
acaccgcgcaggaacaaccaccaggcacagccaacaagcttgctagtgtgtggtttctctcatcaggtcaggaggagcatggccgaccataaggaggagcagtctgtgatggacaagatctccgagaagttccacggcggggactcctcgtcgtcgtctgactcggacgacgagaagaagaaggggtcttcttcggcgtcggcgacggaggccatgaaagccaagatctaccgtctcttcggccgcgagaggcccgtccactctgtcctcggcggcggcaagcccgccgatcttgtcctatggaggaacaagaagatctcaggcggggtactcgctggtgccacggccatctggctcctgttcgaggttatggagtaccatctcctcaccttggtgtgccactgtctcatcgtctcgctggccatcctgttcctgtggtccaacgcctccagtttcatcaacaagtccccaccaaacattcctgaggtgaaaatccctgaggatgtgtctgttaatgttgcactgacactgagatacgagatcaacaggggctttgctaccttgagggagattggacatggacacgatctaaagaaattcctaattgttatcgcaggtctctggctcttttcagttcttgggagctgttgcaacttcctgacactgttctatattgtctttgtggcactgtacactatacctgttctgtatgagaaatatgaggacaaggttgatgcttttggtgagaaggctatgatcgaactgaagaagtattatgccatcttcgatgagaagtgcctatcgaagattccaaagggcctcaaggataagaagcactagattggtagtaaggtacttgatatgaatcaacacccacgttaagtcacaccttccttgaaggatggtgcttggtcctggtctctagttgatagtatataatctgtatgggcaactctggtgtgactgacactttgatctgctgaaaattgttgatcttgtttttggtttcaactttcagcatacttgcctggaagcttgaaacataaaaaaaaaaaaaaaa

SEQ ID NO: 5014 - protein, 253 aa, Zea mays
  misc_feature: PFam Name: Reticulon; PFam Description: Reticulon
  misc_feature: GI Number: 34909318; NR Description: OSJNBb0021A09.5 [Oryza sativa (japonica cultivar-group)] >gi|20160502|dbj|BAB89453.1|
  misc_feature: GI Number: 34904202; NR Description: P0492F05.25 [Oryza sativa (japonica cultivar-group)] >gi|13027362|dbj|BAB32723.1| P0492F05.25 [Oryza sativa (japonica cultivar-group)] >gi|20804416|dbj|BAB92114.1| P0443E07.17 [Oryza sativa (japonica
  misc_feature: GI Number: 50251960; NR Description: putative 24 kDa seed
  misc_feature: GI Number: 52076447; NR Description: putative 24 kDa seed
  misc_feature: GI Number: 34809200; NR Description: RTN4.2-N [Xenopus laevis]
MADHKEEQSVMDKISEKFHGGDSSSSSDSDDEKKKGSSSASATEAMKAKIYRLFGRERPVHSVLGGGKPADLVLWRNKKISGGVLAGATAIWLLFEVMEYHLLTLVCHCLIVSLAILFLWSNASSFINKSPPNIPEVKIPEDVSVNVALTLRYEINRGFATLREIGHGHDLKKFLIVIAGLWLFSVLGSCCNFLTLFYIVFVALYTIPVLYEKYEDKVDAFGEKAMIELKKYYAIFDEKCLSKIPKGLKDKKH

SEQ ID NO: 5015 - DNA, 687 bp, Zea mays
  misc_feature (1)..(687): Ceres cDNA ID no. 22005516
  misc_feature (1)..(687): Ceres CLONE  ID no. 509319
  misc_feature (1)..(687): Also known as  Ceres CDNA ID no. 24372032
aaaccctaaccccatcccgcactccccccctccccccctcccccctcccccaacacgcgcgcgctttcttagccgctaagcatatccctctccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgatgatcccgagtggttcttcttcgcccccaaggaccgcaagtaccccaacggtagcaggtctaacagggccaccgaggcgggatactggaaggctactggcaaggacaggataatcaagtccaagggcgacaagcgcaagcagcataccatcggtatgaagaagaccctcgtcttccaccgcggtcgtgcccccaagggcgagcgcacggggtggattatgcacgagtaccgcaccaccgagcctgagttcgagtccggcgagcagggtggttatgtttgaggccatgggcatctcttggtcctatgctgtgagagcgctgtaatgtgggtaccaaataatggagctgcttttatgcttgtggtgtgaaaaaaaaaaaaaaaa

SEQ ID NO: 5016 - protein, 687 aa, Zea mays
  misc_feature: PFam Name: NAM; PFam Description: No apical meristem (NAM) protein
  misc_feature: PFam Name: FH2; PFam Description: Formin Homology 2 Domain
  misc_feature: GI Number: 50941329; NR Description: NAC2 protein-like [Oryza sativa (japonica cultivar-group)] >gi|37806148|dbj|BAC99653.1| NAC2
  misc_feature: GI Number: 42567421; NR Description: no apical meristem (NAM)
  misc_feature: GI Number: 6910587; NR Description: CDS [Arabidopsis thaliana]
  misc_feature: GI Number: 42562475; NR Description: no apical meristem (NAM)
  misc_feature: GI Number: 42571727; NR Description: no apical meristem (NAM)
AAACCCTAACCCCATCCCGCACTCCCCCCCTCCCCCCCTCCCCCCTCCCCCAACACGCGCGCGCTTTCTTAGCCGCTAAGCATATCCCTCTCCGCCACGATCTCGATGGTGGAGATGTCTGTGGTGGAGCTCAGGACGCTGCCGCTCGGCTTCCGCTTCCACCCCACCGACGAGGAGCTCGTCACCCACTACCTCAAGGGCAAGATCACCGGCAGGATCAACTCCGAGTCCGAGGTCATCCCCGAGATCGACGTCTGCAAGTGCGAGCCGTGGGACCTCCCAGATAAGTCCCTGATCCGGTCCGATGATCCCGAGTGGTTCTTCTTCGCCCCCAAGGACCGCAAGTACCCCAACGGTAGCAGGTCTAACAGGGCCACCGAGGCGGGATACTGGAAGGCTACTGGCAAGGACAGGATAATCAAGTCCAAGGGCGACAAGCGCAAGCAGCATACCATCGGTATGAAGAAGACCCTCGTCTTCCACCGCGGTCGTGCCCCCAAGGGCGAGCGCACGGGGTGGATTATGCACGAGTACCGCACCACCGAGCCTGAGTTCGAGTCCGGCGAGCAGGGTGGTTATGTTTGAGGCCATGGGCATCTCTTGGTCCTATGCTGTGAGAGCGCTGTAATGTGGGTACCAAATAATGGAGCTGCTTTTATGCTTGTGGTGTGAAAAAAAAAAAAAAAA

SEQ ID NO: 5017 - DNA, 827 bp, Zea mays
  misc_feature (1)..(827): Ceres cDNA ID no. 22005517
  misc_feature (1)..(827): Ceres CLONE  ID no. 510475
  misc_feature (1)..(827): Also known as  Ceres CDNA ID no. 24365150
accaccacactgtgcagcagcctcctttcgtctcgtagttggctggggttgccaacgcgacacctcgtcggaatccggtcgcgcgacctccccttctcgccggccggagcgggtgcgccatcaccatggacccggaagcggtacggaaaagcctggagcccaccgcaactgtcgaaaaaatcaccggctccacccctgcgcggctccacttctacgaccccttcgtcctcagcggagtcagcatcgaagccgccgagcacggtcgcctcctctgctcctttgtcgtcacccctcgccttgcgagtcccgcggggtacctccgcagcggtgtcacagcgacgctcgccgaccagctgggatcggccgtgtttttctgcagcgggctccccagcagcggggtatccctcgaaatcagcgtctcctttgttgacgcggctgccgtcggggaggaaatagaggtcgagggaaagctgttgcgtgccggcaagtcagtcggtgtcgtctctgtcgatttcaggaagaaaaagacaggaaaactgatggcgcaggcccgtcacaccaagtatcttgtggcatcaagcagattgtgaggctgcccccttctgttaacaagatgtcaacataattgcgcccgaactgtccattactgatgccattattaataggcagcaacgatacaacgcttgtagtatatcctttatgtcaaattttttttgtgctgtatatttatttacatatgaaatccaagtatcagtggtgcctctgtgacagccaatcaagcgtgatcagataaggtcttgttagcgtgatcaaaaaaaaaaaaaaaa

SEQ ID NO: 5018 - protein, 154 aa, Zea mays
  misc_feature: PFam Name: 4HBT; PFam Description: Thioesterase superfamily
  misc_feature: GI Number: 13605902; NR Description: At1g04290/F19P19_27 [Arabidopsis thaliana] >gi|18491135|gb|AAL69536.1|
  misc_feature: GI Number: 50902184; NR Description: B1065E10.13 [Oryza sativa (japonica cultivar-group)] >gi|20161439|dbj|BAB90363.1|
  misc_feature: GI Number: 13385260; NR Description: thioesterase superfamily member 2 [Mus musculus] >gi|17390369|gb|AAH18165.1| Thioesterase superfamily member 2 [Mus musculus] >gi|23396819|sp|Q9CQR4|TEM2_MOUSE Thioesterase superfamily member
  misc_feature: GI Number: 27685797; NR Description: similar to thioesterase
  misc_feature: GI Number: 50736242; NR Description: PREDICTED: similar to
MDPEAVRKSLEPTATVEKITGSTPARLHFYDPFVLSGVSIEAAEHGRLLCSFVVTPRLASPAGYLRSGVTATLADQLGSAVFFCSGLPSSGVSLEISVSFVDAAAVGEEIEVEGKLLRAGKSVGVVSVDFRKKKTGKLMAQARHTKYLVASSRL

SEQ ID NO: 5019 - DNA, 1498 bp, Glycine max
  misc_feature (1)..(1498): Ceres cDNA ID no. 22005518
  misc_feature (1)..(1498): Ceres CLONE  ID no. 513150
  misc_feature (1)..(1498): Also known as  Ceres CDNA ID no. 23681503
agaagaaagttgaatacagcccggcacgtatcttcggacccattaaaagtttggaaatctttgatatgggcaaacatataaaacgggaatcttcgtcgtggaatctgaggaaacgtcagtatgaaaatcatggagttttcctcgccataatgaacgagagagaatcactagaggcacatgttgttggtagaagaatttctctgggattgactttgattgaatgattgttcactgttcatgctaaacaacacaaaccaaacggctattctgactactttttgatcctgtttctaatcttgtttctaggatcctgtctgtctctcttggtttggtttattagacttgtgctgtgtctaagtctttctttcagggctctgtgagttgaattcaggtgtcacatccaaggcaacaaaacaagatgatgagtccaaaccttgcaaaacaagttggggacacaacctataccaagatctttgttggaggattagcttgggagactaagagagatactttaaaacgctatttcgatcagtttggggagatcttagaggccgtcgtcatcactgacagaatcacaggaagatcaaaaggatatggctttgtgatcttcagggacccaaattctgcaataagagcttgtcataatccctatcctgtgattgatggaaggagagctaactgtaatcttgcagctcttggtgcacagaaatttgatccatctataacaacaggaaggcaaaaattcagtagcccttcatggaatatggcaccaattccattgcaaggaacttccactcattacaatcagcacataccacactacccatttccgcatccagtctacaggtatcctggttatcctcacccacaagacttgtatgaaatgaactacaataatgcttatggtggacagcagcttccactctgttggtttccagcatattgccaacccttttatggccttagtagacagtttattccaacagcatatgtgaaaaaggcacaaacccctgacgtgtcacctcaggagttcacggttgttggcttctcagaacctatttcagcttctccctcaatttgcagcactggattagacacaggaacagtaccagctacaggagtgctagaatcccaccaagaacagaagtcttcaacttaaagctatgatgtcaatttactagaatagagaaagtaaaaaagaaaaatgacactgctgaataaaccaggaagctctaagtacattcccattgaggtggtctagcaaaggaactaaatcaagcaataacgtattgagatctcccatcgatggaacagctgatcctagagacctgacacttatgaagtgaatcctggatttgttcattgtctttgaacatttttttacttttcagcattctggtgcacagtattcattcttcggttttcctttttttttcattttagttttcttttttaaaattggattccagctaagctatagaaaaaaaaaaaaaaaaaa

SEQ ID NO: 5020 - protein, 246 aa, Glycine max
  misc_feature: PFam Name: RRM_1; PFam Description: RNA recognition motif.
  misc_feature: GI Number: 34907334; NR Description: P0698A10.29 [Oryza sativa (japonica cultivar-group)] >gi|20804774|dbj|BAB92459.1| P0698A10.29 [Oryza sativa (japonica cultivar-group)] >gi|22202659|dbj|BAC07317.1| P0471B04.1 [Oryza sativa (japonica
  misc_feature: GI Number: 56784856; NR Description: putative RRM-containing protein SEB-4 [Oryza sativa (japonica cultivar-group)] gi|56784732|dbj|BAD81881.1| putative RRM-containing protein SEB-4
  misc_feature: GI Number: 63003880; NR Description: At2g46780 [Arabidopsis
  misc_feature: GI Number: 3510252; NR Description: putative RNA-binding protein [Arabidopsis thaliana] >gi|7485761|pir||T02679 probable RNA-binding protein [imported] - Arabidopsis thaliana >gi|15226439|ref|NP_182201.1| RNA recognition motif
  misc_feature: GI Number: 51091028; NR Description: putative SEB4D [Oryza sativa (japonica cultivar-group)] >gi|51090851|dbj|BAD35379.1|
MMSPNLAKQVGDTTYTKIFVGGLAWETKRDTLKRYFDQFGEILEAVVITDRITGRSKGYGFVIFRDPNSAIRACHNPYPVIDGRRANCNLAALGAQKFDPSITTGRQKFSSPSWNMAPIPLQGTSTHYNQHIPHYPFPHPVYRYPGYPHPQDLYEMNYNNAYGGQQLPLCWFPAYCQPFYGLSRQFIPTAYVKKAQTPDVSPQEFTVVGFSEPISASPSICSTGLDTGTVPATGVLESHQEQKSST

SEQ ID NO: 5021 - DNA, 2227 bp, Glycine max
  misc_feature (1)..(2227): Ceres cDNA ID no. 22005519
  misc_feature (1)..(2227): Ceres CLONE  ID no. 515695
  misc_feature (1)..(2227): Also known as  Ceres CDNA ID no. 23559724
gagggtttaagcgtttcttctcctatggcattcagcgataagcaaaagcaagaagaagaagaagaaccgcacagaatggaagaagacgacgacgaaagcgaagaagaagaagaagaagaagaagaagaagaagaagaagaagaagaagaagaagtgtgggacgattgggaaggagaagacgaaggagagagagaatctgaattcgtgtgtctattctgtgactcccggtacagttcgtgcggttccttgttcgaccactgcgcctcccttcaccgctttgatttccacacgatcagaacaactctcagcttggatttctatgcctccttcaagctcattaacttcatccgctctcgggtggcagagaacatatgttggagttgtggattaacatgccagtccaactgtgaccttcagaatcatttgcatgatgtagttgactttaatgagataaagactttgtggaatgatgataggtatctgatacctttcatgcaagatgattcactgttgtacagttttggtgattgtgacgaagacggggaagatgaacatattactcgaattgatgaagatcttataaaggatctaatgaacattgaagagagtatccatgacgatcaagatcttgtgaaaaaagtggtagttgatgatgacaaacatgagattgattctgtctctaataatcatttgaacaaggctagttcttcaaagaaacttattaatggtaaggactcaaaaggacatgttttgtgcagtgataaggatccagaaggacatttgatggttaattctcaaaatcacattgcaaagcatattaagaagatcaatgaaagttattttgggtcttacagttcatttggtatccatcgagagatgttaagtgataaggtgagaatggatgcttatggccaagcgattttgaagaatccctctctactaaatagtgctgtggttatggatgtaggttgtggaactggaattctcagcctattttcagcaaaagctggcgcttcaagggttattgcagttgaggctagtgccaagatggcagcagtagcatctcaggttgcaaaagataatggtcttttgctgagtaaaagccaaaatggagttgatggcctccaaaagggagtcatagaagtggttcatggtatggttgaagagattgataaaacagttgaacttcaacctcgcagtgttgatgtattgctaagtgaatggatgggatattgcctgctgtatgaatccatgcttggttcagtgctttatgcacgagaccggtggttgaagcctggtggtgccattcttcctgatacagcaactatttttgttgcaggatttggaaaaggagccacaagtcttcctttttgggaaaatgtgtgtgatttcgacatgtcttgcattgggaatgagcttgtcatagatgctgcccgaattcctatagttgatgttgtggactctcaagatttagttacctgttctgctattcttcagtcctttgacttggcaaccatgaagcctaatgaagtggatttcactgcaactgctactttggaattgaaaccaagtacttctggaacatgctgctggtgttatggtgttgtcctatggtttgatactggattttcaagcagattctgccgagaaacaccagccgtgttatccacattcccttacatgccaagaacacattggtcacaaacaatcttaacctttcaagaacctattgcgatgggatttggaaaagaaaacaggggtaaaccagaagcaattggcactgaggtgtatcctgctgtgaagattgatttacgtgtcagcattgtccgttctactgagcatcgcagcattgatatatccttagaagctgctggtgttggtcctgacagtcacaaacgcagttggcctgctcagcttttaatctgcagtaggatgcatgacgccacaacagcaaagatcattgtgcagcagtttttcttgttggctgccagttaaaatcagttttggaatgctacagctgtaattgctaacatttaggttcctttttttgttcactggaaatagctactgcttgttgaatgctagactctacgctgcccaattacatagaaaatgtaatgtttctccaattcatatttatgtatgacaaaacttacgtgcagtactgttttcttatactgttttccaattaaaattggttattcatttcaaaaaaaaaaaaaaaaaa

SEQ ID NO: 5022 - protein, 656 aa, Glycine max
  misc_feature: PFam Name: MTS; PFam Description: Methyltransferase small domain
  misc_feature: PFam Name: Protamine_P1; PFam Description: Protamine P1
  misc_feature: PFam Name: Chromadorea_ALT; PFam Description: Chromadorea
  misc_feature: PFam Name: PrmA; PFam Description: Ribosomal protein L11
  misc_feature: PFam Name: TT_ORF1; PFam Description: TT viral orf 1
  misc_feature: GI Number: 15795148; NR Description: protein arginine
  misc_feature: GI Number: 12322039; NR Description: arginine N-methyltransferase 3, putative; 35335-37803 [Arabidopsis thaliana] >gi|15230446|ref|NP_187835.1| protein arginine N-methyltransferase
  misc_feature: GI Number: 50510167; NR Description: Protein arginine N-methyltransferase 3-like protein [Oryza sativa (japonica
  misc_feature: GI Number: 56207482; NR Description: novel protein similar to vertebrate HMT1 hnRNP methyltransferase-like 2 (S. cerevisiae)
  misc_feature: GI Number: 28207757; NR Description: CR061 protein
MAFSDKQKQEEEEEPHRMEEDDDESEEEEEEEEEEEEEEEEEEVWDDWEGEDEGERESEFVCLFCDSRYSSCGSLFDHCASLHRFDFHTIRTTLSLDFYASFKLINFIRSRVAENICWSCGLTCQSNCDLQNHLHDVVDFNEIKTLWNDDRYLIPFMQDDSLLYSFGDCDEDGEDEHITRIDEDLIKDLMNIEESIHDDQDLVKKVVVDDDKHEIDSVSNNHLNKASSSKKLINGKDSKGHVLCSDKDPEGHLMVNSQNHIAKHIKKINESYFGSYSSFGIHREMLSDKVRMDAYGQAILKNPSLLNSAVVMDVGCGTGILSLFSAKAGASRVIAVEASAKMAAVASQVAKDNGLLLSKSQNGVDGLQKGVIEVVHGMVEEIDKTVELQPRSVDVLLSEWMGYCLLYESMLGSVLYARDRWLKPGGAILPDTATIFVAGFGKGATSLPFWENVCDFDMSCIGNELVIDAARIPIVDVVDSQDLVTCSAILQSFDLATMKPNEVDFTATATLELKPSTSGTCCWCYGVVLWFDTGFSSRFCRETPAVLSTFPYMPRTHWSQTILTFQEPIAMGFGKENRGKPEAIGTEVYPAVKIDLRVSIVRSTEHRSIDISLEAAGVGPDSHKRSWPAQLLICSRMHDATTAKIIVQQFFLLAAS

SEQ ID NO: 5023 - DNA, 1104 bp, Glycine max
  misc_feature (1)..(1104): Ceres cDNA ID no. 22005520
  misc_feature (1)..(1104): Ceres CLONE  ID no. 515842
  misc_feature (1)..(1104): Also known as  Ceres CDNA ID no. 24402236
aattggagttcacgaaagcgatgccaaaaaaaccaaacaatcattaacaacagccctaacccccccgacgtctttcaaaactgattcggagcaattaatgtaaaatctatggacatcaacgaggaatcttcattctctctccgtttttgtttgcatcattaatagacccaaatggacccgaacccgacagcctcgctggactccgacccggacccgcttcgcgtgaagaggaagaccctcgaggccgtgctcttgcagtgtcagagagctctcgaatcgattaacgctacttctgctactgcttcttcttctgcttctacttacgtggacgaagaggattacgacggtgaaggtgaagccactgcatcagctgatcccgatgccgacgagttatgtgatctgctgaaatctagagttgaatgtccggcctttcttcaacagttggagtgtgctcgggcttcagtttcacagaatatagatgaagaaggtaattcctgggatatggttagcgaaaatgatctctgggaaggtgaacgtgttgactcagaacaagaagattatgtccttgttagacaagaagatatagtggagggtatcgcgtgtttcatggccgcatatttgctatccttaaagcagactaaggatttgacccctatccaactccagagtgcgcttagcaagacattctcagtgaaaaagaaaaagggaaagctacgaaaggcttgggatgggagcaaagttatttataatgttgcatcatggggggctacggccatagggatatatcaaaaccctgttattctcagggctgcaactaaagcattctggacttcatgtcatgttatatcaaagcttctctgatttgcccgtgcagcttgcggcttgtagcaaagttgtgatgtagtaatttaactcttttccccctgcctgtgctgcaatttagcttggcgtcccatgccatgatcgtctttgatttaaaattcaatttctttgaagcacagatcaattgattttaacactgtttgacattgtaaatatcactactctaatgtttccgagtgcaattcaaaactcaagccttaaacataaaaaaaaaaaaaaaaa

SEQ ID NO: 5024 - protein, 229 aa, Glycine max
  misc_feature: GI Number: 50915302; NR Description: MADS box interactor-like [Oryza sativa (japonica cultivar-group)] >gi|47497407|dbj|BAD19444.1| MADS box interactor-like [Oryza sativa
  misc_feature: GI Number: 29367481; NR Description: unknown [Oryza sativa
MDPNPTASLDSDPDPLRVKRKTLEAVLLQCQRALESINATSATASSSASTYVDEEDYDGEGEATASADPDADELCDLLKSRVECPAFLQQLECARASVSQNIDEEGNSWDMVSENDLWEGERVDSEQEDYVLVRQEDIVEGIACFMAAYLLSLKQTKDLTPIQLQSALSKTFSVKKKKGKLRKAWDGSKVIYNVASWGATAIGIYQNPVILRAATKAFWTSCHVISKLL

SEQ ID NO: 5025 - DNA, 1685 bp, Glycine max
  misc_feature (1)..(1685): Ceres cDNA ID no. 22005521
  misc_feature (1)..(1685): Ceres CLONE  ID no. 515925
  misc_feature (1)..(1685): Also known as  Ceres CDNA ID no. 24428761
gaccaatttgttttctgacaaaattgattcatcagaaagtcaatagatagttagcaatgtatgatatatgaaatgtgaagttgagcacattgtatgcaaagttgaaaccggcaaactcggcctaactcatgtcttaggaacaggagcacagcaaaccacccctctctttcaaagcacaacctaagatgtcttgttcttgatttcttgagatattgaaagtcctcatggaggcctttcctgaaatttcaatgactgttgatctgtcgaacactactgtgttgcatactgctgcagcacaaggacacattgaggtagtaaattttctcttggaaaaaggtaatagcctggtaactattgcaaaaagcaatgggaaaactgtgttgcattcttctgcaagaaatggctacatggaggttgtcaaggcttttgtgagcaaagaaccagaaattgcaatgagaattgataaaaaggggcagacagcactccatatggcagttaaaggacagaatcttgagttggtggatgagctcgtgaaattgaatccatctttggccaatatggtggataccaaggggaacactgcactgcatatagcaacccggaagggtcgtctacaggttgttcagaagttactagattgcagagaaataaacacagatgttatcaacaaatctggagaaactgctttagatactgcagagaaaaatggtcgtttggaaattgccaactttctgcaacatcatggagctcaaagtgccaagtccatcaagtcacctactacaaacacggcccttgagctcaaacaaacagtgagtgacataaaaagtggggttcataaccagctggaacacacaattaaaacgcaaagacgtatgcaaggtatagcgaagcgaatcaacaaaatgcacactgaggggcttaacaatgcgatcaactccaacattgttgttgctgtccttattgcaacagttgcttttgctgccatatttaatgtcccgggccagtatcctgagaaaccaagtgaactctctcctggaatgtctcctggggaagcatatattgctccagatattggattcatgatattcataatctttgattctactgccctcttcatatcattggctgttgtgattgtccaaacatcagtggttgttattgagaggaaagcaaagagacaaatgatggcagttataaataagttgatgtgggttgcatgtgtgctgatttctgtggcatttattgcaatgtcatacataattgttggggatcataaagagttggctatagcagccacagctctaggaacagtgattatggcagctactttaggaacactctgttattgggtgattgctcatcgccttgaggcctcaagattgcgaagtcttaggacaacaatgagcagtaggcagtcaatgtctatgtcaatgatgtcaggatcagagaatgagtataagacagtgtatgcaatataactttgatttctaccatttcagagttctccctccttttttggccagttacactaacattgtaggtgtttgttgcttagtaaaacaaacattaactaatgcaacaaaagcatgcctttgcagaacataggcaaaagatgtaatcatagtccacttgataagtgaatgttattctaaattgaaagtattggatcaaaaaaaaaaaaaaaa

SEQ ID NO: 5026 - protein, 417 aa, Glycine max
  misc_feature: PFam Name: Ank; PFam Description: Ankyrin repeat
  misc_feature: GI Number: 8777346; NR Description: ankyrin-like protein [Arabidopsis thaliana] >gi|15238604|ref|NP_200815.1| ankyrin repeat
  misc_feature: GI Number: 24796797; NR Description: putative ankyrin repeat
  misc_feature: GI Number: 4887754; NR Description: ankyrin-like protein [Arabidopsis thaliana] >gi|25408188|pir||E84725 ankyrin-like protein [imported] - Arabidopsis thaliana >gi|15225141|ref|NP_180741.1| ankyrin repeat family protein
  misc_feature: GI Number: 7413651; NR Description: ankyrin-like protein [Arabidopsis thaliana] >gi|11357168|pir||T48283 ankyrin-like
  misc_feature: GI Number: 50726643; NR Description: ankyrin-like protein [Oryza sativa (japonica cultivar-group)] >gi|50725332|dbj|BAD34405.1| ankyrin-like protein [Oryza sativa
MEAFPEISMTVDLSNTTVLHTAAAQGHIEVVNFLLEKGNSLVTIAKSNGKTVLHSSARNGYMEVVKAFVSKEPEIAMRIDKKGQTALHMAVKGQNLELVDELVKLNPSLANMVDTKGNTALHIATRKGRLQVVQKLLDCREINTDVINKSGETALDTAEKNGRLEIANFLQHHGAQSAKSIKSPTTNTALELKQTVSDIKSGVHNQLEHTIKTQRRMQGIAKRINKMHTEGLNNAINSNIVVAVLIATVAFAAIFNVPGQYPEKPSELSPGMSPGEAYIAPDIGFMIFIIFDSTALFISLAVVIVQTSVVVIERKAKRQMMAVINKLMWVACVLISVAFIAMSYIIVGDHKELAIAATALGTVIMAATLGTLCYWVIAHRLEASRLRSLRTTMSSRQSMSMSMMSGSENEYKTVYAI

SEQ ID NO: 5027 - DNA, 1664 bp, Glycine max
  misc_feature (1)..(1664): Ceres cDNA ID no. 22005523
  misc_feature (1)..(1664): Ceres CLONE  ID no. 517901
  misc_feature (1)..(1664): Also known as  Ceres CDNA ID no. 24360182
acctaggaaaaaccgtttccaactttacattttcccaccaaccctcctctccattcctcaaaacaatcgttaatctcttctccattgtgaactctgatattctccaagtacacaacacaaacacacatcaatttatagcacccgatttctcttttccccctcaaattcagctccattttgttacagattcaaataataagccaagcagccacaccatgatctcgtcaatgaaatgcacagcctcatctctcacatgttctgctttctcaaacagaaagcttcccattgcaaggcctcaactcgtgacattaccaaccatcaacaacgttgaacaaaacatgggtccctctcagttgtgttcacagaagcctctctacctttcatccaccgagaacttggcattggtgaggagaaggagagtgacggagtgccaggcctatgaagctgacaggtcacggcctctggagatcaacattgagctgccggctgaagaggcggcgcagaggttcaagattggtgtgtattttgctacatggtgggctttgaatgtagttttcaacatttacaataagaaggttttgaatgcttttccttacccatggctcacctccactttgtcccttgctgctggctccctcatgatgttagtctcatgggccaccagggttgctgaggtcccaaaagtcaacttggacttctggaaggccttgtttcctgttgcggtggcacacacaattgggcatgttgctgcaactgtgagcatgtccaaggttgctgtttcattcactcacatcatcaagagtggagagccagctttcagtgtccttgtgtcaaggttcttgctcggagaagcattcccaatgccggtttatctgtcactgctgccaattattggtggttgtgcactagctgcagtgactgagctcaatttcaacatgattggcttcatgggggctatgatatcaaatttggcatttgtcttccgcaatatattctcaaagaaagggatgaagggaatgtctgttagtggaatgaactactatgcttgtctttccataatgtcactgttaattctgacaccttttgccattgctgttgagggccccaaggtttgggctgcaggctggcaaacagctgtatctcaaattggtcccaattttgtatggtgggtagctgcacagagtgtcttttaccacttgtacaatcaagtctcatacatgtctcttgatcagatttctcccttaacatttagcattggaaacacaatgaagaggatttcggtcattgtttcttccatccttatctttcacacgcctgttcagcccatcaatgctcttggtgctgccattgcaattcttggcaccttcctctattcacaggctaaacagtaaggtggttattttgaagcttttatgtaacacaaggaaacgatgactcatggttggagctcaaagtgtcactgatgaggactatggcattaattagctagtatgttttgttgttaataggaatttaagtttatttcttttgggccatagcagcagcatttgtaatcacgttttgatctttgtaaattagctttagaaggatggaatgcactaaactgtacttaatcttgaggctgaaagtctatgaagaatttcttgaaaaaaaaaaaaaaaaaa

SEQ ID NO: 5028 - protein, 1664 aa, Glycine max
  misc_feature: GI Number: 16323151; NR Description: AT5g54800/MBG8_6 [Arabidopsis thaliana] >gi|7229675|gb|AAF42936.1| glucose 6 phosphate/phosphate translocator [Arabidopsis thaliana]
  misc_feature: GI Number: 3367515; NR Description: Similar to glucose-6-phosphate/phosphate-translocator (GPT) gb|AF020814 from Pisum sativum. [Arabidopsis thaliana] >gi|7484980|pir||T02126 glucose-6-phosphate/phosphate translocator precursor -
  misc_feature: GI Number: 27752361; NR Description:
  misc_feature: GI Number: 9758260; NR Description:
  misc_feature: GI Number: 21554690; NR Description:
ACCTAGGAAAAACCGTTTCCAACTTTACATTTTCCCACCAACCCTCCTCTCCATTCCTCAAAACAATCGTTAATCTCTTCTCCATTGTGAACTCTGATATTCTCCAAGTACACAACACAAACACACATCAATTTATAGCACCCGATTTCTCTTTTCCCCCTCAAATTCAGCTCCATTTTGTTACAGATTCAAATAATAAGCCAAGCAGCCACACCATGATCTCGTCAATGAAATGCACAGCCTCATCTCTCACATGTTCTGCTTTCTCAAACAGAAAGCTTCCCATTGCAAGGCCTCAACTCGTGACATTACCAACCATCAACAACGTTGAACAAAACATGGGTCCCTCTCAGTTGTGTTCACAGAAGCCTCTCTACCTTTCATCCACCGAGAACTTGGCATTGGTGAGGAGAAGGAGAGTGACGGAGTGCCAGGCCTATGAAGCTGACAGGTCACGGCCTCTGGAGATCAACATTGAGCTGCCGGCTGAAGAGGCGGCGCAGAGGTTCAAGATTGGTGTGTATTTTGCTACATGGTGGGCTTTGAATGTAGTTTTCAACATTTACAATAAGAAGGTTTTGAATGCTTTTCCTTACCCATGGCTCACCTCCACTTTGTCCCTTGCTGCTGGCTCCCTCATGATGTTAGTCTCATGGGCCACCAGGGTTGCTGAGGTCCCAAAAGTCAACTTGGACTTCTGGAAGGCCTTGTTTCCTGTTGCGGTGGCACACACAATTGGGCATGTTGCTGCAACTGTGAGCATGTCCAAGGTTGCTGTTTCATTCACTCACATCATCAAGAGTGGAGAGCCAGCTTTCAGTGTCCTTGTGTCAAGGTTCTTGCTCGGAGAAGCATTCCCAATGCCGGTTTATCTGTCACTGCTGCCAATTATTGGTGGTTGTGCACTAGCTGCAGTGACTGAGCTCAATTTCAACATGATTGGCTTCATGGGGGCTATGATATCAAATTTGGCATTTGTCTTCCGCAATATATTCTCAAAGAAAGGGATGAAGGGAATGTCTGTTAGTGGAATGAACTACTATGCTTGTCTTTCCATAATGTCACTGTTAATTCTGACACCTTTTGCCATTGCTGTTGAGGGCCCCAAGGTTTGGGCTGCAGGCTGGCAAACAGCTGTATCTCAAATTGGTCCCAATTTTGTATGGTGGGTAGCTGCACAGAGTGTCTTTTACCACTTGTACAATCAAGTCTCATACATGTCTCTTGATCAGATTTCTCCCTTAACATTTAGCATTGGAAACACAATGAAGAGGATTTCGGTCATTGTTTCTTCCATCCTTATCTTTCACACGCCTGTTCAGCCCATCAATGCTCTTGGTGCTGCCATTGCAATTCTTGGCACCTTCCTCTATTCACAGGCTAAACAGTAAGGTGGTTATTTTGAAGCTTTTATGTAACACAAGGAAACGATGACTCATGGTTGGAGCTCAAAGTGTCACTGATGAGGACTATGGCATTAATTAGCTAGTATGTTTTGTTGTTAATAGGAATTTAAGTTTATTTCTTTTGGGCCATAGCAGCAGCATTTGTAATCACGTTTTGATCTTTGTAAATTAGCTTTAGAAGGATGGAATGCACTAAACTGTACTTAATCTTGAGGCTGAAAGTCTATGAAGAATTTCTTGAAAAAAAAAAAAAAAAAA

SEQ ID NO: 5029 - DNA, 1194 bp, Glycine max
  misc_feature (1)..(1194): Ceres cDNA ID no. 22005524
  misc_feature (1)..(1194): Ceres CLONE  ID no. 521078
  misc_feature (1)..(1194): Also known as  Ceres CDNA ID no. 24402304
gagctacgacacaacacaacacaacacaacacaacacagtcctaagttgtaagaaacactctcttctccttcctcactattgttctgttactgttttttgcagcaacacttcagttcaattaacgaactacaccactttctttctcttcttcgactgctctgtaaccgaaaacctccctttcccagtttcgaatcttttgtttctgcctttggttactgtttttccgagccatgctattcattattgtccttcgaatcggattggtaacaaggaatttatgtgtgtagattgggacactgtattgcatgtaaatcaggaaatcatgacttctactcatgacctctcagataatgaagctgatgaccagcagcagtcggaatcacaaatggagcctttatctgcaaatggaatttcttatgcaggtattgctactcagaatgttcagtatgcaacaccttcacagcttggaactgggcatgctgtggtaccgcccacttacccatatccagatccatactacagaagtatctttgctccctatgatgcacaaacttatcccccacaaccctatggtggaaatccaatggtccaccttcagttaatgggaattcaacaagcaggtgttcctttgccaactgatacagttgaggagcctgtgtttgtcaatgcaaaacagtatcatggtatattaagacgcagacagtcccgtgctaaagctgaatcagaaaaaaaggctgcaaggaatcggaagccatacttgcatgaatctcgacatttgcatgcactgagaagagcaagaggatgtggaggtcggtttttgaattcaaagaaagatgagaatcaacaggatgaggttgcatcaactgacgaatcacagtccactatcaatctcaattctgataaaaatgagcttgcaccatcagatagaacatcctaaaactacagaaatggtgatgctgtagattgcagggatctgttgtgtatatctatattgggagatgaatctccaaccaacagtatcctcagatatctccctattattcattctgtcgtacaacgccataggtataagtataggttgtgtagtaggtatgttaggaggttgcaaaataaaacaagtaaaatgtaaattgaagtgattcaactaagtctatccccaatgtggtcctttcttgccaaaaaaaaaaaaaaaa

SEQ ID NO: 5030 - protein, 1194 aa, Glycine max
  misc_feature: PFam Name: CBFB_NFYA; PFam Description: CCAAT-binding
  misc_feature: GI Number: 28973313; NR Description: putative transcription factor [Arabidopsis thaliana] >gi|28393728|gb|AAO42275.1| putative transcription factor [Arabidopsis thaliana] >gi|30691872|ref|NP_849733.1| CCAAT-binding transcription factor
  misc_feature: GI Number: 6634774; NR Description: Contains similarity to gb|Y13720 Hap2a transcription factor from Arabidopsis thaliana
  misc_feature: GI Number: 30691791; NR Description: CCAAT-binding transcription factor (CBF-B/NF-YA) family protein [Arabidopsis
  misc_feature: GI Number: 21389663; NR Description: putative CCAAT-binding transcription factor subunit [Arabidopsis thaliana] >gi|18252959|gb|AAL62406.1| putative CCAAT-binding transcription factor subunit [Arabidopsis thaliana]
  misc_feature: GI Number: 50917949; NR Description: putative CCAAT-binding transcription factor [Oryza sativa (japonica cultivar-group)] >gi|27552556|gb|AAO19379.1| putative CCAAT-binding transcription
GAGCTACGACACAACACAACACAACACAACACAACACAGTCCTAAGTTGTAAGAAACACTCTCTTCTCCTTCCTCACTATTGTTCTGTTACTGTTTTTTGCAGCAACACTTCAGTTCAATTAACGAACTACACCACTTTCTTTCTCTTCTTCGACTGCTCTGTAACCGAAAACCTCCCTTTCCCAGTTTCGAATCTTTTGTTTCTGCCTTTGGTTACTGTTTTTCCGAGCCATGCTATTCATTATTGTCCTTCGAATCGGATTGGTAACAAGGAATTTATGTGTGTAGATTGGGACACTGTATTGCATGTAAATCAGGAAATCATGACTTCTACTCATGACCTCTCAGATAATGAAGCTGATGACCAGCAGCAGTCGGAATCACAAATGGAGCCTTTATCTGCAAATGGAATTTCTTATGCAGGTATTGCTACTCAGAATGTTCAGTATGCAACACCTTCACAGCTTGGAACTGGGCATGCTGTGGTACCGCCCACTTACCCATATCCAGATCCATACTACAGAAGTATCTTTGCTCCCTATGATGCACAAACTTATCCCCCACAACCCTATGGTGGAAATCCAATGGTCCACCTTCAGTTAATGGGAATTCAACAAGCAGGTGTTCCTTTGCCAACTGATACAGTTGAGGAGCCTGTGTTTGTCAATGCAAAACAGTATCATGGTATATTAAGACGCAGACAGTCCCGTGCTAAAGCTGAATCAGAAAAAAAGGCTGCAAGGAATCGGAAGCCATACTTGCATGAATCTCGACATTTGCATGCACTGAGAAGAGCAAGAGGATGTGGAGGTCGGTTTTTGAATTCAAAGAAAGATGAGAATCAACAGGATGAGGTTGCATCAACTGACGAATCACAGTCCACTATCAATCTCAATTCTGATAAAAATGAGCTTGCACCATCAGATAGAACATCCTAAAACTACAGAAATGGTGATGCTGTAGATTGCAGGGATCTGTTGTGTATATCTATATTGGGAGATGAATCTCCAACCAACAGTATCCTCAGATATCTCCCTATTATTCATTCTGTCGTACAACGCCATAGGTATAAGTATAGGTTGTGTAGTAGGTATGTTAGGAGGTTGCAAAATAAAACAAGTAAAATGTAAATTGAAGTGATTCAACTAAGTCTATCCCCAATGTGGTCCTTTCTTGCCAAAAAAAAAAAAAAAA

SEQ ID NO: 5031 - DNA, 1172 bp, Glycine max
  misc_feature (1)..(1172): Ceres cDNA ID no. 22005525
  misc_feature (1)..(1172): Ceres CLONE  ID no. 527282
  misc_feature (1)..(1172): Also known as  Ceres CDNA ID no. 24424432
acctcacagcagagcaaaagaaagaaagaaactgcaacttcctctgttttgctcccctgtttaggccttttcataagcttagaatgacacacaaggaattttccattgctctagtgactctcattgctgttctctttgtcaacatgaacatccaaggtgccactgctgactatggtagttggcagagtgctcatgccactttttatggcgggggtgatgcttctggcacaatgggtggagcatgtgggtatggaaatttgtatagccagggctatggaactgacactgtggctctaagcactgctttgttcaacaatggcttaagctgtggatcttgctatgaaatgagatgtgatgatgacccaagatggtgcaaacctggctccattactgtaactgccactaacttctgccccccaaacccttctttgcctaacaacaatgggggttggtgcaaccctcctttgcaacactttgatatggctgaacctgccttcttgcaaattgctgaatatagagctggaattgtgcctgttgcctttaggagggttccttgtgtgaaaaaggggggaataaggttcacaatcaatggccactcatacttcaacctagttttgatcaccaatgtgggtggagctggtgatgtgaattcagtgtccatcaaagggtccaaaactgggtggcaacccatgtcaaggaattgggggcaaaattggcagagcaactcatacctcaatggacaatccctctcttttcaagtcaccaccagtgatggtagaactgtgacaagcttcaacgtggcaccagccaattggcaatttggccagaccttccaaggaggccaatactagagacattattgcaaatttacaatggggggtagaaaatagtgcaacaaaaaaaaatgtttgtatacctattattaatcacctcattggaagaaccattaaaagtgtcattaataggtattgattcttgtaactgtgattctgaaaggccagtgttttttattttattggtctaaaaagtagctgaggtgtttatatagcacccgctggtcacttcgcatataatatacatatatggagagagttacgcgttatcttgtgtgcggtggtgctacttttcttcaattcaagttaattaataattagaaaaaaaaaaaaaaaaaa

SEQ ID NO: 5032 - protein, 255 aa, Glycine max
  misc_feature: PFam Name: DPBB_1; PFam Description: Rare lipoprotein A
  misc_feature: PFam Name: Pollen_allerg_1; PFam Description: Pollen allergen
  misc_feature: GI Number: 11932092; NR Description: alpha-expansin [Cicer
  misc_feature: GI Number: 3510538; NR Description: expansin [Prunus armeniaca]
  misc_feature: GI Number: 13898651; NR Description: expansin [Prunus
  misc_feature: GI Number: 29467503; NR Description: expansin [Pyrus communis]
  misc_feature: GI Number: 7025493; NR Description: expansin 2 [Zinnia elegans]
MTHKEFSIALVTLIAVLFVNMNIQGATADYGSWQSAHATFYGGGDASGTMGGACGYGNLYSQGYGTDTVALSTALFNNGLSCGSCYEMRCDDDPRWCKPGSITVTATNFCPPNPSLPNNNGGWCNPPLQHFDMAEPAFLQIAEYRAGIVPVAFRRVPCVKKGGIRFTINGHSYFNLVLITNVGGAGDVNSVSIKGSKTGWQPMSRNWGQNWQSNSYLNGQSLSFQVTTSDGRTVTSFNVAPANWQFGQTFQGGQY

SEQ ID NO: 5033 - DNA, 1435 bp, Glycine max
  misc_feature (1)..(1435): Ceres cDNA ID no. 22005526
  misc_feature (1)..(1435): Ceres CLONE  ID no. 527836
  misc_feature (1)..(1435): Also known as  Ceres CDNA ID no. 24402766
agttgcagttgcagttcttcaaaatgattatatcatctaccttttacataattccaacccagaagccacgtctcaaacaaacccattctttcagattccgaaacaacacagtttttcgtgtaaactgtgtttgactcaagaggaagaagacatgatgagtggttctccttctccaaattcaaaacagagaacatgcgactattgtggggacttcacggctcttctgtattgcagtgccgattctgcgaagctatgtttcttctgtgaccgcaaagttcactccccaaaccagcttttctccaagcacacgcgagcgcagctctgtgattcgtgtggagattcccctgcttcggtgctctgttctgcagagaactctgttctttgccataactgtgactgcgaaaagcacaaacatttggcgtctgaagtgcaccaacgaaaacccctcgaggggttctcggggtgcccttctgtgactgagttgttaacgattcttggtctttctgaaaaatctctgctttcaaatgaggggacttcccagattgattacgacctttcggatttgcacgtgtggagtgctccttctgttaacggtcttgaatatttgatcacttccacagcttcttctcataagaatcgtaagagtgcgtttgggagacacaaagaagagattcttagtcaactccgtgagctaataaagttggagcccgacttgattcatggagaagtagatgctgagcgacaagggcaatttggaaatttgcctactggctttgaacgtgacgtggaggctagtatgtttccttcatatgaggcaggtgtgttttgttggcatggagaaagcagtgatcctacaaatcaaattgttccttccgatacgtcatcattgagagattttggcgaggtagtttcagctgaagatggaagttttaccatccctggaactggaactcaagccaattttaacaacgaagggaaaccatcaaactcttttaactctgaaaacttatctcctactcctaaagctactccatatgagttaacaagtcatgaaagagattcagcattattgcgatacagagagaagaagaaaaccagaagatatgacaagcacatcagatatgaatcacgaaaagttcgggcagaaagcaggatgagaattaagggtcggtttgtcaaagatgaaacacaaaaataacagtacattactaattacatcacacctgtaattctcagcttttgtcacaatgtatgcaacatgtctgttgcacaacattttgtttaattaaagttttttatgtttttcgaattgctagattatatagatatcctctaaaaaacagattatatagatataaattgtaatttggcccttctgttcttgataaaatggaattagtggctggcaattttgattaaaaaaaaaaaaaaaaaa

SEQ ID NO: 5034 - protein, 1435 aa, Glycine max
  misc_feature: PFam Name: zf-B_box; PFam Description: B-box zinc finger
  misc_feature: PFam Name: CCT; PFam Description: CCT motif
  misc_feature: GI Number: 25083442; NR Description: putative CONSTANS-like B-box zinc finger protein [Arabidopsis thaliana] >gi|30685731|ref|NP_850211.1| zinc finger (B-box type) family protein [Arabidopsis thaliana] >gi|53618008|sp|O22800|COLE_ARATH
  misc_feature: GI Number: 42571031; NR Description: zinc finger (B-box type)
  misc_feature: GI Number: 27363356; NR Description: At1g28050/F13K9_15 [Arabidopsis thaliana] >gi|14335054|gb|AAK59791.1| At1g28050/F13K9_15 [Arabidopsis thaliana] >gi|25403051|pir||B86406 probable protein CONSTANS family zinc
  misc_feature: GI Number: 42571277; NR Description: zinc finger (B-box type)
AGTTGCAGTTGCAGTTCTTCAAAATGATTATATCATCTACCTTTTACATAATTCCAACCCAGAAGCCACGTCTCAAACAAACCCATTCTTTCAGATTCCGAAACAACACAGTTTTTCGTGTAAACTGTGTTTGACTCAAGAGGAAGAAGACATGATGAGTGGTTCTCCTTCTCCAAATTCAAAACAGAGAACATGCGACTATTGTGGGGACTTCACGGCTCTTCTGTATTGCAGTGCCGATTCTGCGAAGCTATGTTTCTTCTGTGACCGCAAAGTTCACTCCCCAAACCAGCTTTTCTCCAAGCACACGCGAGCGCAGCTCTGTGATTCGTGTGGAGATTCCCCTGCTTCGGTGCTCTGTTCTGCAGAGAACTCTGTTCTTTGCCATAACTGTGACTGCGAAAAGCACAAACATTTGGCGTCTGAAGTGCACCAACGAAAACCCCTCGAGGGGTTCTCGGGGTGCCCTTCTGTGACTGAGTTGTTAACGATTCTTGGTCTTTCTGAAAAATCTCTGCTTTCAAATGAGGGGACTTCCCAGATTGATTACGACCTTTCGGATTTGCACGTGTGGAGTGCTCCTTCTGTTAACGGTCTTGAATATTTGATCACTTCCACAGCTTCTTCTCATAAGAATCGTAAGAGTGCGTTTGGGAGACACAAAGAAGAGATTCTTAGTCAACTCCGTGAGCTAATAAAGTTGGAGCCCGACTTGATTCATGGAGAAGTAGATGCTGAGCGACAAGGGCAATTTGGAAATTTGCCTACTGGCTTTGAACGTGACGTGGAGGCTAGTATGTTTCCTTCATATGAGGCAGGTGTGTTTTGTTGGCATGGAGAAAGCAGTGATCCTACAAATCAAATTGTTCCTTCCGATACGTCATCATTGAGAGATTTTGGCGAGGTAGTTTCAGCTGAAGATGGAAGTTTTACCATCCCTGGAACTGGAACTCAAGCCAATTTTAACAACGAAGGGAAACCATCAAACTCTTTTAACTCTGAAAACTTATCTCCTACTCCTAAAGCTACTCCATATGAGTTAACAAGTCATGAAAGAGATTCAGCATTATTGCGATACAGAGAGAAGAAGAAAACCAGAAGATATGACAAGCACATCAGATATGAATCACGAAAAGTTCGGGCAGAAAGCAGGATGAGAATTAAGGGTCGGTTTGTCAAAGATGAAACACAAAAATAACAGTACATTACTAATTACATCACACCTGTAATTCTCAGCTTTTGTCACAATGTATGCAACATGTCTGTTGCACAACATTTTGTTTAATTAAAGTTTTTTATGTTTTTCGAATTGCTAGATTATATAGATATCCTCTAAAAAACAGATTATATAGATATAAATTGTAATTTGGCCCTTCTGTTCTTGATAAAATGGAATTAGTGGCTGGCAATTTTGATTAAAAAAAAAAAAAAAAAA

SEQ ID NO: 5035 - DNA, 1167 bp, Glycine max
  misc_feature (1)..(1167): Ceres cDNA ID no. 22005528
  misc_feature (1)..(1167): Ceres CLONE  ID no. 532400
  misc_feature (1)..(1167): Also known as  Ceres CDNA ID no. 24402410
gacacaggtcaaaataacttcatagactatccctcaccttctccgttgaacccttgaaaaacacactccactccgatgaagcccacgcacaatcagatagaaaaaagataatcaaaattttacttccaaacccaaccaaatcaaagaaatgaaggataaggagacattccctattgcgaaaaaggaagcctctgattcaggtttattcggaagaggaagctacaaattctgggcactagctgccatgctgctcttggcattctggtccatgttcaccggcacagtctctctccgctggtccggcaccctcaacactttctcccacgcgtcccttcacgaccacctcgacgtcctcgaaatcgaggagcgggagaagctggtgaggcacatgtgggacgtgtacacgaataaccgtaggatcaggttgccgcggttctgggaaaaggccttcgaggctgcctacgaggatttgaccagcgacgccgccgatgttagagacgttgccgtcgccgagatcgttaacatgtctctgcgctccttggatctccaattgcctcctagagcacggaaacttagtaagaatctcaaggaagttgagaaaggcaaaggagcaacctccgaacgtgcttagagattagaatgtggagcaaccaaaaggtctgatttacttcaaaaggaaaagggtcatgttaccaaaagttgagaaaggcgaagtcatactcggattttcatgccttcataaattgggaaattatgtattttagtaggttgtgattctttcaaattttgcagtcaatttcataatcatcacaatgtgagtgctagtaaattagagcttgaaagataggggtgggtaaacggattcaggtccatggactgatccacggggcctgtagtccgcgcgggtaacggaccaatttttttaaacggtccatggttatgtcatatttttgggccgtccgctcaacttgtgaactatgcgggtttggctcgtgggttgtccgcatttgaattttattacttcaaatatgaaatcatttgttgttgaagatgtttaagtttcatattttagatttattgcttgtattttgttttgttaagatattgtttattttattgatgtaattgactaattgttaagattttattaaaaaaaaaaaaaaaaaa

SEQ ID NO: 5036 - protein, 160 aa, Glycine max
  misc_feature: GI Number: 45773768; NR Description: At4g36660 [Arabidopsis thaliana] >gi|45752648|gb|AAS76222.1| At4g36660 [Arabidopsis
  misc_feature: GI Number: 9858772; NR Description: BAC19.4 [Lycopersicon
MKDKETFPIAKKEASDSGLFGRGSYKFWALAAMLLLAFWSMFTGTVSLRWSGTLNTFSHASLHDHLDVLEIEEREKLVRHMWDVYTNNRRIRLPRFWEKAFEAAYEDLTSDAADVRDVAVAEIVNMSLRSLDLQLPPRARKLSKNLKEVEKGKGATSERA

SEQ ID NO: 5037 - DNA, 1259 bp, Glycine max
  misc_feature (1)..(1259): Ceres cDNA ID no. 22005529
  misc_feature (1)..(1259): Ceres CLONE  ID no. 533648
  misc_feature (1)..(1259): Also known as  Ceres CDNA ID no. 25088230
ggtgtgagcatgaatgtgggtgtgtgtgagatgcattctgtaatctgcagcaccgtcgtttcactttcaccatacgactcttgtcgccggaaccctaaccgattgcgcgccaaatcctctctgctcgttcagaaacaggacgcccaactctccgactccgactccgactccgtctccgtctcgcgccgcctcattctccttcgccatgctaagagttcctgggataatcgctctctccgcgaccatgaccggccactgagcaagtctgggaaagaggatgctgtgagagtttcccgcaggctccaacagttgggttggattcctgaacttatcttgtccagtgatgcagcgcggactaaggagacgcttaagataatgcaggagcaagtgcaggagctggtggaagccgaggttcattttgtttctagtttctattcgattgcagctatggatgggcaaacggcagagcaccttcaaaagattatttgtaaatattcaagggatgagatacttactataatgtgcatgggacacaatagggggtgggaagaagcagcatcaatgttttctggggcctctgtggaattaaagacttgcaatgctgcactgcttgagtctgctggaaaatcctgggatgaggcatttgccactgcaggatttggtggctggaagcttcagggtataataaaaccaagtagctagctagttgagattttccgtactgggtaaacttaaaaatagatatgcaagaggttggaagcatcattacttattcaaggaacccaaaacgcctcagttaaggctacagagctgatgacttcggaaagtatatacttgaggaaagatgaatatgatggcaaaagcttcagttagatgtgtttaatttagcagctatgaattgtttacatggtgattcaagatgaaacgttgctgtggataatgtgcaggatctcaatgcttcatatatgctgcttggtgttgagcatttgttcattgaagtgaactcatgctgctcagtggttgttaatacatgcacaactacaggtttccaaaggaaaaaaatattgcttctgtaaatcatatgctgtggcaaaaaaaagaggcatttcctgttactttacttcccttttaccccttctcttctaccttgataataaagattggaaatctatttcgaaataccaaaatggtattggttaatgattatcatcaacctagacaagaagtcttggcttaaatgcaaaaaaaaaaaaaaaaaa

SEQ ID NO: 5038 - protein, 1259 aa, Glycine max
  misc_feature: PFam Name: PGAM; PFam Description: Phosphoglycerate mutase family
  misc_feature: GI Number: 48856760; NR Description: COG2062:
  misc_feature: GI Number: 53802752; NR Description: phosphoglycerate mutase family domain protein [Methylococcus capsulatus str. Bath] >gi|53756513|gb|AAU90804.1| phosphoglycerate mutase family domain
  misc_feature: GI Number: 48835224; NR Description: COG2062:
  misc_feature: GI Number: 46202721; NR Description: COG2062: Phosphohistidine phosphatase SixA [Magnetospirillum magnetotacticum
  misc_feature: GI Number: 22959081; NR Description: COG2062:
GGTGTGAGCATGAATGTGGGTGTGTGTGAGATGCATTCTGTAATCTGCAGCACCGTCGTTTCACTTTCACCATACGACTCTTGTCGCCGGAACCCTAACCGATTGCGCGCCAAATCCTCTCTGCTCGTTCAGAAACAGGACGCCCAACTCTCCGACTCCGACTCCGACTCCGTCTCCGTCTCGCGCCGCCTCATTCTCCTTCGCCATGCTAAGAGTTCCTGGGATAATCGCTCTCTCCGCGACCATGACCGGCCACTGAGCAAGTCTGGGAAAGAGGATGCTGTGAGAGTTTCCCGCAGGCTCCAACAGTTGGGTTGGATTCCTGAACTTATCTTGTCCAGTGATGCAGCGCGGACTAAGGAGACGCTTAAGATAATGCAGGAGCAAGTGCAGGAGCTGGTGGAAGCCGAGGTTCATTTTGTTTCTAGTTTCTATTCGATTGCAGCTATGGATGGGCAAACGGCAGAGCACCTTCAAAAGATTATTTGTAAATATTCAAGGGATGAGATACTTACTATAATGTGCATGGGACACAATAGGGGGTGGGAAGAAGCAGCATCAATGTTTTCTGGGGCCTCTGTGGAATTAAAGACTTGCAATGCTGCACTGCTTGAGTCTGCTGGAAAATCCTGGGATGAGGCATTTGCCACTGCAGGATTTGGTGGCTGGAAGCTTCAGGGTATAATAAAACCAAGTAGCTAGCTAGTTGAGATTTTCCGTACTGGGTAAACTTAAAAATAGATATGCAAGAGGTTGGAAGCATCATTACTTATTCAAGGAACCCAAAACGCCTCAGTTAAGGCTACAGAGCTGATGACTTCGGAAAGTATATACTTGAGGAAAGATGAATATGATGGCAAAAGCTTCAGTTAGATGTGTTTAATTTAGCAGCTATGAATTGTTTACATGGTGATTCAAGATGAAACGTTGCTGTGGATAATGTGCAGGATCTCAATGCTTCATATATGCTGCTTGGTGTTGAGCATTTGTTCATTGAAGTGAACTCATGCTGCTCAGTGGTTGTTAATACATGCACAACTACAGGTTTCCAAAGGAAAAAAATATTGCTTCTGTAAATCATATGCTGTGGCAAAAAAAAGAGGCATTTCCTGTTACTTTACTTCCCTTTTACCCCTTCTCTTCTACCTTGATAATAAAGATTGGAAATCTATTTCGAAATACCAAAATGGTATTGGTTAATGATTATCATCAACCTAGACAAGAAGTCTTGGCTTAAATGCAAAAAAAAAAAAAAAAAA

SEQ ID NO: 5039 - DNA, 1919 bp, Glycine max
  misc_feature (1)..(1919): Ceres cDNA ID no. 22005530
  misc_feature (1)..(1919): Ceres CLONE  ID no. 534958
  misc_feature (1)..(1919): Also known as  Ceres CDNA ID no. 24403155
gaacaaaacataccttactcactagcctaatttgctcctttagcctcactcctgctctcttctacgtcaaatcctaagaaacccatttgaaattttaaatctcgttctggctaattccatgttcattgtttactatacctcaccactccaagggtctcataaatttcttctgcttccaactctgctgcagaaaaagaaactgttggttctagatacaagtgggtttccagagtagaagtgaggctattgggcatgagataaacagcaagcaccatcatctacgacccttttgactatattataagcaacacaaaaatggagagtgacttgagctgggagcagaacacgctcataaatgagctaattcaggggatggaggtagcaaggaagttgaaggcagacttgaggatgccgtattcagttgactcaagagatttgcttgtgcagaggatattatcttcttatgaaaaggctctactgattctaagatgcaatgcatcatcaacttccgagttgcaggccatgagtcaagcaacaccaactttgctacccgagtccccattatctgtccatggaagtcctctgcgcgaggacgttgatgggaccatcaaggatcaccaagaagttaaacatgattcaaagaaaagaaaggcaacgcccaaatggatggatcatgtaagagtgagctgtgaaagtggtcttgaaggaccacatgaagatagctacaactggagaaaatatggtcagaaagacatccttggagccaaatatcccagaagttactataggtgcaccttccgcaacactcagggctgttgggcaacaaagcaagtgcagagatcagatgaagatcccacagtatttgacataacttacagaggcaagcatacctgttctcagggaaacaatgccgttctgccacctaagtcaccagaaaaacaagaaaaaccaacacacagtcataacattgatattcaccgtgcacaggcatctcaagaaagccttacaaagttcagaaacatcttgtctatcaacacagataatctgaacaatggagatatggcatatcctttcactttcccttcaacttcatttggatgcatgaaacaagacaaccacagcttgattccttgggccctggagaacgagtccttcttaagcgacctataccaaacacaccttttatccacaacaataccagaatcaaactatttcccatctccaactttccagatgaatgtgtttgatgggatctacagcaagccacattcggaatccgatatcaatgagatcatttccaccaacacatcagcaaccaattctccaattcctgatttcaatttctcacttgatccagtggaaattgacccaaatttccctttcaataccccaggacttttctcctgattgcatttcactataaatggaatactataagcacatagtcttcctaaaatgggacaacttcagacagcagtaaaattgtagaataaagaatgagcaactgcagcacttatgaaggtccttgtggcttgtagtcaatatcagaattacaattttggcactgagttagcaattagcagtatgtactttcaaataaaatagtctctccaaatttgcattggtacaacctacaagacacatctttagcagaagagctgaagagcatagcagtcacaaagaacagctaactaaaccaaattaagttacaagattacatcatccaaaaaaagaatattattcttataagagagcttttagaacattattgaagggtagtaaagggagcagataaaaaattacacatcaaaattggatacgctggccaaaactctgtaacatttcattcgaattgatgatttaattacacaaatatccagcccttatttccaaaaaaaaaaaaaaaaaaaaaaaaaaaa

SEQ ID NO: 5040 - protein, 363 aa, Glycine max
  misc_feature: PFam Name: WRKY; PFam Description: WRKY DNA -binding domain
  misc_feature: GI Number: 40846374; NR Description: putative WRKY
  misc_feature: GI Number: 30681651; NR Description: WRKY family transcription factor [Arabidopsis thaliana] >gi|24762209|gb|AAN64171.1| putative WRKY family transcription
  misc_feature: GI Number: 46394392; NR Description: TPA: WRKY transcription
  misc_feature: GI Number: 34911952; NR Description: P0694A04.6 [Oryza sativa (japonica cultivar-group)] >gi|15290030|dbj|BAB63724.1| P0694A04.6
  misc_feature: GI Number: 50843958; NR Description: transcription factor
MESDLSWEQNTLINELIQGMEVARKLKADLRMPYSVDSRDLLVQRILSSYEKALLILRCNASSTSELQAMSQATPTLLPESPLSVHGSPLREDVDGTIKDHQEVKHDSKKRKATPKWMDHVRVSCESGLEGPHEDSYNWRKYGQKDILGAKYPRSYYRCTFRNTQGCWATKQVQRSDEDPTVFDITYRGKHTCSQGNNAVLPPKSPEKQEKPTHSHNIDIHRAQASQESLTKFRNILSINTDNLNNGDMAYPFTFPSTSFGCMKQDNHSLIPWALENESFLSDLYQTHLLSTTIPESNYFPSPTFQMNVFDGIYSKPHSESDINEIISTNTSATNSPIPDFNFSLDPVEIDPNFPFNTPGLFS

SEQ ID NO: 5041 - DNA, 1600 bp, Glycine max
  misc_feature (1)..(1600): Ceres cDNA ID no. 22005531
  misc_feature (1)..(1600): Ceres CLONE  ID no. 535116
  misc_feature (1)..(1600): Also known as  Ceres CDNA ID no. 25401138
aattaaggattaaaagcaaagtaataataacagaaatgatcgcctcaagtagtagcgcagaacccaaagactcttctacagtagctccagtctcaaacgagcaaccagtgcaatcccccaacactactgaacaatcaaatcaagagcagcaagagttacagatattgatacctcaatggcaagccatgacctttcctgatgcatacttgccactactgattgcatatgtgaattcagcagacgtgaagatgcaatattgtggagttattggcctaaggaagctcttgtctaatcaacacagtcttccaattcagccagtgcttgattctgggatagttccaaccctgactcaaatagtccaaacttcattgaataccacaatacaacgtgaggctgcttgtgctttgtcaaatctatgtagcggtactccacaacaaacacagaaagtagtagatcagggagttattccatgctttatctcaagacttgattctccttatgaagatcttattgaaaaatgtcttttgggacttggaaatattgctggagattcagctggaattagagattgcatcattcagcatggtgcaatcgagccaatgatgaaggttgtagagaaaacgacactcttatctaccaaaactcaaggaacttgggcgttatcaaatatatttaaaacgaaaccaacaccaccttctacaataacctcaaaggttctcccattcttctgtaatctgttaaagaccgaggagacttctgatgtcctgtcagatgcagcttggggcgtacttcattgctcaatgacaagcgaagcgattgactttataataagttctgatgtgagctcacgcctggttagtcttctgagcaattcttcactgactattgtcgttccttgcttaagagcagttggaaatatagtctcaggttcagatgaacaaacagaggctatattaaaagaaaaggagctatttccaagcttaatgaaattaattgaaagtccagttaaatcaattcgaagagacgttttctgggttttctcaaatctcgcattaggatcatcagacgacattgaaaccataatgggtgaccccgcttttatggaaaaggtgatctccacagcaaaaaatgataaatccatcgatgttagaagagaagctgttttcgtcttagcaaactatgtagttactcatatccctgcctttggtacttatgattgtttaattgagcttctcaaggcatccaaagaaaaaatgctactagttgttcttgaaggtatcgaaaaatgtttaaagcatggaaagcaatgggaattaaatgatgaaaacggagggaataagattttagtgccattgaaaaataatgaagtagtccaaaatttagaagcattgaagtctcattctgatggccaagtttgtaaaatcgttgcaagaatattgaaaaattactttggattcgatgaagactcagaagaagaagacgaagaaaatgatgaggaggatgaggaagaagaaggagagggggatgataataaagaggtggcatcatctgcaggatgaatggaggagaagggggagaatagaaaaaaaaaaaaaaaaaa

SEQ ID NO: 5042 - protein, 507 aa, Glycine max
  misc_feature: PFam Name: Arm; PFam Description:
  misc_feature: GI Number: 50404869; NR Description: Importin alpha, putative [Paramecium tetraurelia] gi|50057246|emb|CAH03230.1| Importin
  misc_feature: GI Number: 30421147; NR Description: importin alpha
  misc_feature: GI Number: 48106091; NR Description: similar to Importin alpha-7 subunit (Karyopherin alpha-6 subunit) (Importin alpha S2)
  misc_feature: GI Number: 66533927; NR Description: PREDICTED: similar to
  misc_feature: GI Number: 48734622; NR Description: Unknown (protein for
MIASSSSAEPKDSSTVAPVSNEQPVQSPNTTEQSNQEQQELQILIPQWQAMTFPDAYLPLLIAYVNSADVKMQYCGVIGLRKLLSNQHSLPIQPVLDSGIVPTLTQIVQTSLNTTIQREAACALSNLCSGTPQQTQKVVDQGVIPCFISRLDSPYEDLIEKCLLGLGNIAGDSAGIRDCIIQHGAIEPMMKVVEKTTLLSTKTQGTWALSNIFKTKPTPPSTITSKVLPFFCNLLKTEETSDVLSDAAWGVLHCSMTSEAIDFIISSDVSSRLVSLLSNSSLTIVVPCLRAVGNIVSGSDEQTEAILKEKELFPSLMKLIESPVKSIRRDVFWVFSNLALGSSDDIETIMGDPAFMEKVISTAKNDKSIDVRREAVFVLANYVVTHIPAFGTYDCLIELLKASKEKMLLVVLEGIEKCLKHGKQWELNDENGGNKILVPLKNNEVVQNLEALKSHSDGQVCKIVARILKNYFGFDEDSEEEDEENDEEDEEEEGEGDDNKEVASSAG

SEQ ID NO: 5043 - DNA, 1068 bp, Glycine max
  misc_feature (1)..(1068): Ceres cDNA ID no. 22005532
  misc_feature (1)..(1068): Ceres CLONE  ID no. 536345
  misc_feature (1)..(1068): Also known as  Ceres CDNA ID no. 24398654
ggtctatttgtctttctcttccttccccaccaaaatttccctttcacacttcacaaaaaagaaatactaaatgatttgtcagtagcagcaaacatgtccagcaagggaaaggagatagcagaaggatcatcaacaacaacaacagcaacaagatcctctcatggaggtgacgatcatcatcatcaccacaatcagcagcagcagcaacaacaacaacagttaccactgagtcgctatgagtctcagaagagaagggattggaacacttttggacagtacctgaggaaccaaaggcctccagtggcactttctcagtgcagctccaaccatgttcttgagttccttcgctacttggaccagtttgggaagaccaaagtgcactcacaagggtgcttgttctttgggcaaactgagccgccaggaccctgcacttgccctctcagacaagcttgggggagccttgatgcactcattggaagattgagagctgcatatgaagaaaatggaggccttcctgagaccaatccttttgcaagtggcaccataagagtctatcttagagaggtgagagattctcaggctaaggctagaggaatcccttataagaagaaaaagaagaagaggaatgttatcaggcccaacggagacacctcctcctcaaacttgcctatgcagtaataataattaaagaggagcatgtgatatctctaaattgtttcaaagtcgtgaatctgttgctaggccttggatataacttcagctgcaaacttggaattctggttataattgactatctggacatatccctgggtcaactttaacccttcggtggtctttatgtgtcaaggagtgtattttgttatttcgaatgagagtttagaatgaagttgacgaaaagtttaacattgggggtaagtccctgtattatatttacttatatatatttacactatcaagcatattatatagtcatgaaaataatgtgtatgatattgcatatggtattggtatcgtttgattaattctctgggaagctaaaaaaaaaaaaagaaaaaaaaaaaaaaaaaa

SEQ ID NO: 5044 - protein, 194 aa, Glycine max
  misc_feature: GI Number: 21592379; NR Description: unknown [Arabidopsis thaliana]
  misc_feature: GI Number: 34907938; NR Description: B1088C09.17 [Oryza sativa (japonica cultivar-group)] >gi|15624056|dbj|BAB68109.1|
  misc_feature: GI Number: 34909440; NR Description: OSJNBa0014K08.14 [Oryza sativa (japonica cultivar-group)] >gi|21902040|dbj|BAC05589.1|
MSSKGKEIAEGSSTTTTATRSSHGGDDHHHHHNQQQQQQQQQLPLSRYESQKRRDWNTFGQYLRNQRPPVALSQCSSNHVLEFLRYLDQFGKTKVHSQGCLFFGQTEPPGPCTCPLRQAWGSLDALIGRLRAAYEENGGLPETNPFASGTIRVYLREVRDSQAKARGIPYKKKKKKRNVIRPNGDTSSSNLPMQ

SEQ ID NO: 5045 - DNA, 2260 bp, Glycine max
  misc_feature (1)..(2260): Ceres cDNA ID no. 22005534
  misc_feature (1)..(2260): Ceres CLONE  ID no. 543055
  misc_feature (1)..(2260): Also known as  Ceres CDNA ID no. 24401969
gatgcatcgcgtttctctctcttagttcaaatttcgaattcggaagcagcaaaactaaagcccaaaaacccataccaagatgctcctccgaagccactgttgctacctcggcataatcgccgggctagcagtgttcctcgcaacgacgtcgttcgccgacgcgcaatcctgcaacggcatcctcgtctcatacgcctacaccggcggcctgcggttgccgcccaacgtctccgactcggctaagcagccgtaccggttcgagtcgacggtgacggttctcaacaacggcctcgacgagctcaagtcgtggaaggtcttcgttgggttcgaccacgacgagttgttggtctccgcctccaatgctgtgctcgccgacggcaccaccctccccgccgccgtcggaaacggcaccgtcttcgccggtttccccatgactgatctcaagaccgccgtcgaaaccgccggcgacttgacccagatgcaggctcagatcgaactcgtcggcaccgtgttcggggtggcgccgcccagtgttccgatgccgaaatccatcaacctcgccaatgatggtttcctctgtcgcaaatccaccgctcaagggaagaatgcgagtagtgtgtgttgcacgagagatcccaagttcaaaactaacattactacggatgaagagtttctgccacgtcagagtggtgatcttaccattatgtatgatgtgatcagaacttatgattcaaattactgggctgaggttaccgttgcaaaccataacccacttgggaggcttgataactggaggttgagctgggactggatgaatgatgagtttatatattcaatgaaaggggcttatccttcggttgtggatgcttctgattgtctctttggtaagcaaggaactttctatagggatcttgactttgcccttgtgttgaattgtgagagaaggccaaccataattgatctccctcccaccaagttcaatgattccgaccttgggaagattcccttttgttgccggaatggtactattttgcctccgtccatggatcctagcatgtctgcttcgagattccaaatgcaggtcttcaagatgccgccggcgcttaaccgatcccagctttcgccaccgcagaactggaagataagtggcacactcaaccctgactatgaatgtggccctccagtaagagtgagtcctaccgaaaatcctgacccgtccggcttaccttcaaacaaaactgtgatggccagttggcaggttgtgtgcaacataacaacagccaagagaacatcaagtaaatgctgtgtctcgttttcatcttattacaatgattcagttattccatgcaaaacatgtgcttgtggatgccccaagaacacagagagaacatgtagtactagtgctccagctatgtggcttccaccagaggcacttcttgttccctttgtgaaccgaactgccaaggctgttgcttgggcaagtctgaaacatctccgggtgccaaacccattgccgtgtagcgataactgtggtgtgagcatcaattggcatttgtacacagactacactaaaggatggagtgcaagggtgacactttttaactggggtgacactaattttgcagactggtttgccgcagtacaaatggacaaagcagcttcgggttttgagaaaatgtattcattcaatgcaactcttctagatggtgtaaacaatacaataatcatgcaaggtttgccaggattgaactaccttgtagcagaagcagatggagctgaccctttgagagatcctagggtgcctggtaaacaacaatcagttatctcatttacaaagaaaactactcctggaatcaacgtagctcgtggagatgggtttcccactaaggtatttttcaatggcgaagaatgttctcttccttcagtgtatccaagcagtagtggtttcaggaatggtttttcattggctacttccttgcttctaacactgttgatgatcctcttgatgcggtaatagtggctactgagtcccgagacacgatttgattcatatattgacctcaccacagaaactcagtggacttaatcgtgctgttgtaacattcatgcgtgtgtctgtctggtttggatgctgtggcattcattgttcaattatacgtgattcttttgagcttgttatagtacagaagattgtagatttatgttagatgatagaaatatattcctttttatgttaaaagtttaaaaaaaaaaaaaaaaa

SEQ ID NO: 5046 - protein, 644 aa, Glycine max
  misc_feature: PFam Name: Phytochel_synth; PFam Description: Phytochelatin
  misc_feature: GI Number: 52076665; NR Description: COBRA-like protein
  misc_feature: GI Number: 34898176; NR Description: cell wall protein-like [Oryza sativa (japonica cultivar-group)] >gi|22831184|dbj|BAC16043.1| cell wall protein-like [Oryza sativa
  misc_feature: GI Number: 34733385; NR Description: roothairless 3 [Zea mays]
MLLRSHCCYLGIIAGLAVFLATTSFADAQSCNGILVSYAYTGGLRLPPNVSDSAKQPYRFESTVTVLNNGLDELKSWKVFVGFDHDELLVSASNAVLADGTTLPAAVGNGTVFAGFPMTDLKTAVETAGDLTQMQAQIELVGTVFGVAPPSVPMPKSINLANDGFLCRKSTAQGKNASSVCCTRDPKFKTNITTDEEFLPRQSGDLTIMYDVIRTYDSNYWAEVTVANHNPLGRLDNWRLSWDWMNDEFIYSMKGAYPSVVDASDCLFGKQGTFYRDLDFALVLNCERRPTIIDLPPTKFNDSDLGKIPFCCRNGTILPPSMDPSMSASRFQMQVFKMPPALNRSQLSPPQNWKISGTLNPDYECGPPVRVSPTENPDPSGLPSNKTVMASWQVVCNITTAKRTSSKCCVSFSSYYNDSVIPCKTCACGCPKNTERTCSTSAPAMWLPPEALLVPFVNRTAKAVAWASLKHLRVPNPLPCSDNCGVSINWHLYTDYTKGWSARVTLFNWGDTNFADWFAAVQMDKAASGFEKMYSFNATLLDGVNNTIIMQGLPGLNYLVAEADGADPLRDPRVPGKQQSVISFTKKTTPGINVARGDGFPTKVFFNGEECSLPSVYPSSSGFRNGFSLATSLLLTLLMILLMR

SEQ ID NO: 5047 - DNA, 1547 bp, Glycine max
  misc_feature (1)..(1547): Ceres cDNA ID no. 22005535
  misc_feature (1)..(1547): Ceres CLONE  ID no. 544824
  misc_feature (1)..(1547): Also known as  Ceres CDNA ID no. 24402545
tctctcgcggtctctcttcttccatgccgtgacttgcttcaacgtctatctgtgactgtcactgctatagcaacaaacctcacacaaatggcgtgttgctataagtaccataacctatttctccactctcatttcttgttgagaaagcttccgttcccgcgccacgtcaacgccacgagtttctctcgcaatcttcgaaccccgtggctgcttcgttcttcgcgcgcgccactctctaagggctattgtagtgctacttcagaatcgccgggagctgttcccgcgactccgccaaccgccgcggcgacgttggttcccggcgccggaatcggaaccgctcgggcgatgcagttaggttctgctgtcaatgcggaacgtgtgacgaacagcgatcctttgaatggcagagtgatgatcattgacggtacttcgattattcaccgcgcgtactacaagcttttagcaaagttgcaccatggccatctaacacatgctgatggaaatggagattgggttttaatgatgtttacggcactatcgcttataattgatgttttggaatttatcccttcccatgtggtggtagtgtttgaccatgatggaattcctattggtcatacatataattcatcaaaagaaagttttactgcaaaaggccagaattttcggcacaatctataccctgcatacaagagcaaccgtcctccaactcctgataccattgttcagggacttcaatacttcaaagcatccatcaaggctatgtccataaaaatcatcgaggttccaggtgtagaggcagatgatgtgattggaacattagccttaaggagtgttgatgctgggtacaaggtacgagttgtctcccccgacaaagatttttttcagattttatctccttcgctgcgtctccttcgaattgctccacgtggtgatcagatggtttcatttggagttgaggattttgaagagagatatggaggtctgaaaccatcccagtttgcagatatgatcgcacttactggtgatagatctgataatattccaggagttcatggaattggagatgttcatgctgtgcaattaatcagtagatttggcacattggagaggttgttggattctgtggatcaaattaaagaggatcgcattaaaaaggccttgatcgaaaatgctgagcaggcagtcttgagcaaggaactggcattgttgcgttctgatcttccattgtacatggtaccgctcgctataagagatctctcgtttaataaaccagaggacaatggtagcaaattcaacagccttttaacagctatcagtgcatacgcagaagggttttcagctgatcctatcatcaggagaacagttcatttgtggggaaagttggattcaagatgaaactcgttgagtcatcaggttttcttgtatagaggggattctttgaatagaacatttcaatacttgaacagtacataacacgagggttttcaagtgtatatagtaaagcagagcgagttgttcttgtgtggaaaaaaaaaaaaaaaaaa

SEQ ID NO: 5048 - protein, 436 aa, Glycine max
  misc_feature: PFam Name: 5_3_exonuc_N; PFam Description: 5'-3'
  misc_feature: PFam Name: 5_3_exonuc; PFam Description: 5'-3' exonuclease,
  misc_feature: GI Number: 42565846; NR Description: 5'-3' exonuclease family
  misc_feature: GI Number: 42572637; NR Description: 5'-3' exonuclease family
  misc_feature: GI Number: 4090935; NR Description: DNA polymerase type I
  misc_feature: GI Number: 4731571; NR Description: DNA polymerase I
  misc_feature: GI Number: 15644367; NR Description: DNA-directed DNA polymerase I [Thermotoga maritima MSB8] >gi|7434817|pir||E72232 DNA-directed DNA polymerase I - Thermotoga maritima (strain MSB8) >gi|4982191|gb|AAD36686.1| DNA-directed DNA polymerase I
MACCYKYHNLFLHSHFLLRKLPFPRHVNATSFSRNLRTPWLLRSSRAPLSKGYCSATSESPGAVPATPPTAAATLVPGAGIGTARAMQLGSAVNAERVTNSDPLNGRVMIIDGTSIIHRAYYKLLAKLHHGHLTHADGNGDWVLMMFTALSLIIDVLEFIPSHVVVVFDHDGIPIGHTYNSSKESFTAKGQNFRHNLYPAYKSNRPPTPDTIVQGLQYFKASIKAMSIKIIEVPGVEADDVIGTLALRSVDAGYKVRVVSPDKDFFQILSPSLRLLRIAPRGDQMVSFGVEDFEERYGGLKPSQFADMIALTGDRSDNIPGVHGIGDVHAVQLISRFGTLERLLDSVDQIKEDRIKKALIENAEQAVLSKELALLRSDLPLYMVPLAIRDLSFNKPEDNGSKFNSLLTAISAYAEGFSADPIIRRTVHLWGKLDSR

SEQ ID NO: 5049 - DNA, 1298 bp, Glycine max
  misc_feature (1)..(1298): Ceres cDNA ID no. 22005536
  misc_feature (1)..(1298): Ceres CLONE  ID no. 547155
  misc_feature (1)..(1298): Also known as  Ceres CDNA ID no. 23490285
gagacctccagccaaaagaaaattcgaccacctctctctctctctctctctctctgacagggatcgcgacgagcggcgccaccgtcactgatcgaagagaaacttcgacatcggaacctgccgcagccacctccaccaccaccgcgcacttcaactctctttcagcaaaaaaaattgtcactcaaatggatttggagacggaaaacagattagctgctatgcttatgagggaagcagcagaattacggcggcagtctgaaagggaaggagttctggcttatcttcgcaagcctaatatacggacccgaccaaattcacgtttcctcactgcaactgttcgtggagtacaacaagcaaatcgagctgtggaagtgaatgagatgtggcgattgaggcaaaaagagctcgagctggataaacgtgttaaagaaaaatctttgggtaaaagcagtagagatagaagccatggggatgataactcatcaagaggcacaggaagacatgctagtattgataatagcacttcaacctcctcctcttcaaggtcaggtaaaagagagtatgagttggataaatgggttaaagacacatcaaaagataaaagcagcggtgacaggagctatagggctggaaactcatcaagaagcgccggaagacatgctgcagtggataaaagcactagtgcacatgcttcatgctccagtgaaagagaatatgagcatggtctggaaggtttaaaggatgaagagcttgaggagtttctacactcaaggaccaagcgaggcagaggtgctgttggtccaaggatggatgagactggaccttaccttcctcatttggaaggggagcctagtactagtcccgatgtaagggagcatcgtgttatttatggtccagagaagcctctgtcattgaggccatatgaatcttctgatgaggaggagcttcatgaagaaaggcggaaaaagagtaaaaagtctcattctaagaactcagacaaggagcgttctaagaagcacaggtccaaagataaatctaagcataagaaaaagaaaagggaggagaaacgaagtaaacatcatcactgaggctcttctgtaacttgatattctcacatgaaggttataactagcggatacagggaattcggatgcagctcgtgtgtattttgtacagataattttctgtaaaatcaaatgcaaatccaaccagtttggccatttgatgcaaaagtaattattaatttcaattgacttgtgttaagggagaatatttaagctaaaaaaaaaaaaaaaaaa

SEQ ID NO: 5050 - protein, 1298 aa, Glycine max
  misc_feature: GI Number: 38604020; NR Description: At4g33690 [Arabidopsis thaliana] >gi|38454078|gb|AAR20733.1| At4g33690 [Arabidopsis
  misc_feature: GI Number: 15081747; NR Description: AT4g33690/T16L1_180
GAGACCTCCAGCCAAAAGAAAATTCGACCACCTCTCTCTCTCTCTCTCTCTCTCTGACAGGGATCGCGACGAGCGGCGCCACCGTCACTGATCGAAGAGAAACTTCGACATCGGAACCTGCCGCAGCCACCTCCACCACCACCGCGCACTTCAACTCTCTTTCAGCAAAAAAAATTGTCACTCAAATGGATTTGGAGACGGAAAACAGATTAGCTGCTATGCTTATGAGGGAAGCAGCAGAATTACGGCGGCAGTCTGAAAGGGAAGGAGTTCTGGCTTATCTTCGCAAGCCTAATATACGGACCCGACCAAATTCACGTTTCCTCACTGCAACTGTTCGTGGAGTACAACAAGCAAATCGAGCTGTGGAAGTGAATGAGATGTGGCGATTGAGGCAAAAAGAGCTCGAGCTGGATAAACGTGTTAAAGAAAAATCTTTGGGTAAAAGCAGTAGAGATAGAAGCCATGGGGATGATAACTCATCAAGAGGCACAGGAAGACATGCTAGTATTGATAATAGCACTTCAACCTCCTCCTCTTCAAGGTCAGGTAAAAGAGAGTATGAGTTGGATAAATGGGTTAAAGACACATCAAAAGATAAAAGCAGCGGTGACAGGAGCTATAGGGCTGGAAACTCATCAAGAAGCGCCGGAAGACATGCTGCAGTGGATAAAAGCACTAGTGCACATGCTTCATGCTCCAGTGAAAGAGAATATGAGCATGGTCTGGAAGGTTTAAAGGATGAAGAGCTTGAGGAGTTTCTACACTCAAGGACCAAGCGAGGCAGAGGTGCTGTTGGTCCAAGGATGGATGAGACTGGACCTTACCTTCCTCATTTGGAAGGGGAGCCTAGTACTAGTCCCGATGTAAGGGAGCATCGTGTTATTTATGGTCCAGAGAAGCCTCTGTCATTGAGGCCATATGAATCTTCTGATGAGGAGGAGCTTCATGAAGAAAGGCGGAAAAAGAGTAAAAAGTCTCATTCTAAGAACTCAGACAAGGAGCGTTCTAAGAAGCACAGGTCCAAAGATAAATCTAAGCATAAGAAAAAGAAAAGGGAGGAGAAACGAAGTAAACATCATCACTGAGGCTCTTCTGTAACTTGATATTCTCACATGAAGGTTATAACTAGCGGATACAGGGAATTCGGATGCAGCTCGTGTGTATTTTGTACAGATAATTTTCTGTAAAATCAAATGCAAATCCAACCAGTTTGGCCATTTGATGCAAAAGTAATTATTAATTTCAATTGACTTGTGTTAAGGGAGAATATTTAAGCTAAAAAAAAAAAAAAAAAA

SEQ ID NO: 5051 - DNA, 1498 bp, Glycine max
  misc_feature (1)..(1498): Ceres cDNA ID no. 22005538
  misc_feature (1)..(1498): Ceres CLONE  ID no. 554057
  misc_feature (1)..(1498): Also known as  Ceres CDNA ID no. 24403450
gataaaccccatagcatctcactccattcacgaaacatcgaaacaaaaatagaaaatgggtactaacagatctttaatggccacgatcctcatcgtgttcttcacggtgttggcagtgtcatcggcgttggacatgtcgataatctcgtatgacagaagccacgcggacaagtcagggtggaagagtgacgaggaggtaatgagtatatacgaggagtggcttgtgaagcatgggaaggtgtataacgccgtcgaagagaaggagaagaggtttcagatcttcaaagacaacttcaactttatcgaagaacacaatgctgtgaaccggacatacaaggttggactgaaccggttcagtgatcttagcaacgaggagtaccggtcaaaatacctgggaaccaagattgatcccagcagaatgatggccagaccaagtagacgttactctccgcgcgtggctgacaatttgccggaatctgttgattggaggaaagaaggtgctgttgtcagagtcaaaaaccaatcagaatgcgagggctgctgggcattctcagcaattgccgcagttgaaggaattaacaagatagtaacaggcaatctaactgcactgtcagagcaagaactgttggactgtgatagaaccgtcaatgcaggatgtagtggcggacttgtggactatgcctttgagttcattatcaacaatggtggcattgacactgaagaggattacccctttcaaggtgctgatggtatctgtgatcaatacaagataaatgctagagctgttacaattgatggttacgaacgtgttcctgcttatgatgaattagccttgaaaaaggcagtagcaaatcaacccgtgagcgttgccattgaagcatatggcaaagagtttcaattatatgaatctggtatattcacaggaacatgtgggacatcaatagaccatggtgttacagctgttgggtacggaacagaaaatggaattgactattggatcgtcaaaaattcatggggtgagaattggggagaggcaggttatgtaagaatggaacgtaatatagcagaagacactgcaggaaagtgtggaattgcgattctgacattgtatcccataaagattggccaaaatccctcaaacccagataactccagctaaacccaccgggaatttacaggaaataacaggaagactaaaagagttctagacttctgtttagtggaagttatctagcccatgaatgaaaaggtgaaaaaagagaagattaggccgtactcattctctattctctaatttgaaccagccatcaaggccgtacgagaaagatattcaaggtgggaagatcacattccttttttcctcttccttctaataaatctttgtttttagtttttctatgcctagctaaatcctttttgatggagttaggagaatttctatgtaacccacagggatttttaataaaattatgtttttctcaaaaaaaaaaaaaaaaaa

SEQ ID NO: 5052 - protein, 1498 aa, Glycine max
  misc_feature: PFam Name: Peptidase_C1; PFam Description: Papain family
  misc_feature: GI Number: 2511693; NR Description: cysteine proteinase precursor [Phaseolus vulgaris] >gi|7435791|pir||T12041 cysteine
  misc_feature: GI Number: 62526575; NR Description: cysteine protease CP1
  misc_feature: GI Number: 18141285; NR Description: senescence-associated
  misc_feature: GI Number: 22136972; NR Description: putative cysteine proteinase RD21A [Arabidopsis thaliana] >gi|18175926|gb|AAL59952.1| putative cysteine proteinase RD21A [Arabidopsis thaliana] >gi|435619|dbj|BAA02374.1| thiol protease cysteine protease,
  misc_feature: GI Number: 62320725; NR Description: cysteine proteinase
GATAAACCCCATAGCATCTCACTCCATTCACGAAACATCGAAACAAAAATAGAAAATGGGTACTAACAGATCTTTAATGGCCACGATCCTCATCGTGTTCTTCACGGTGTTGGCAGTGTCATCGGCGTTGGACATGTCGATAATCTCGTATGACAGAAGCCACGCGGACAAGTCAGGGTGGAAGAGTGACGAGGAGGTAATGAGTATATACGAGGAGTGGCTTGTGAAGCATGGGAAGGTGTATAACGCCGTCGAAGAGAAGGAGAAGAGGTTTCAGATCTTCAAAGACAACTTCAACTTTATCGAAGAACACAATGCTGTGAACCGGACATACAAGGTTGGACTGAACCGGTTCAGTGATCTTAGCAACGAGGAGTACCGGTCAAAATACCTGGGAACCAAGATTGATCCCAGCAGAATGATGGCCAGACCAAGTAGACGTTACTCTCCGCGCGTGGCTGACAATTTGCCGGAATCTGTTGATTGGAGGAAAGAAGGTGCTGTTGTCAGAGTCAAAAACCAATCAGAATGCGAGGGCTGCTGGGCATTCTCAGCAATTGCCGCAGTTGAAGGAATTAACAAGATAGTAACAGGCAATCTAACTGCACTGTCAGAGCAAGAACTGTTGGACTGTGATAGAACCGTCAATGCAGGATGTAGTGGCGGACTTGTGGACTATGCCTTTGAGTTCATTATCAACAATGGTGGCATTGACACTGAAGAGGATTACCCCTTTCAAGGTGCTGATGGTATCTGTGATCAATACAAGATAAATGCTAGAGCTGTTACAATTGATGGTTACGAACGTGTTCCTGCTTATGATGAATTAGCCTTGAAAAAGGCAGTAGCAAATCAACCCGTGAGCGTTGCCATTGAAGCATATGGCAAAGAGTTTCAATTATATGAATCTGGTATATTCACAGGAACATGTGGGACATCAATAGACCATGGTGTTACAGCTGTTGGGTACGGAACAGAAAATGGAATTGACTATTGGATCGTCAAAAATTCATGGGGTGAGAATTGGGGAGAGGCAGGTTATGTAAGAATGGAACGTAATATAGCAGAAGACACTGCAGGAAAGTGTGGAATTGCGATTCTGACATTGTATCCCATAAAGATTGGCCAAAATCCCTCAAACCCAGATAACTCCAGCTAAACCCACCGGGAATTTACAGGAAATAACAGGAAGACTAAAAGAGTTCTAGACTTCTGTTTAGTGGAAGTTATCTAGCCCATGAATGAAAAGGTGAAAAAAGAGAAGATTAGGCCGTACTCATTCTCTATTCTCTAATTTGAACCAGCCATCAAGGCCGTACGAGAAAGATATTCAAGGTGGGAAGATCACATTCCTTTTTTCCTCTTCCTTCTAATAAATCTTTGTTTTTAGTTTTTCTATGCCTAGCTAAATCCTTTTTGATGGAGTTAGGAGAATTTCTATGTAACCCACAGGGATTTTTAATAAAATTATGTTTTTCTCAAAAAAAAAAAAAAAAAA

SEQ ID NO: 5053 - DNA, 1259 bp, Glycine max
  misc_feature (1)..(1259): Ceres cDNA ID no. 22005540
  misc_feature (1)..(1259): Ceres CLONE  ID no. 562303
  misc_feature (1)..(1259): Also known as  Ceres CDNA ID no. 24402358
agtgaacaacaagtcttacattaggtggaggatatttggaaacagctagcaactatggctctcatgcagcttactagctctcatgttgccttattgctccgtttcatagtaatatttgctctatgttacagaacaatggctttggtgaagttgccaccaaacgcttcatcagttccggcagttttagcgtttggagattcgatcgtggactcaggcaacaacaacaacataaaaacactgattaagtgcaacttcttaccttatggaaaagattttcagggaggaaacccaactggtcgattttgcaatggaaaaattccttctgacctaatagttgaacaattgggtattaaggagtatttgcctgcatatttggatccgaatctcaaatctagcgatcttgttaccggcgtcggctttgcctccggtgcttcaggatacgatcctttgacacccaaaataacgtcagttatatcattatctactcaactagacatgttcagggaatacataggaaagctgaaaggaattgttggagagagcagaacaaactacatcctagccaacagtctttatcttgtggtggcaggcagtgacgacattgccaacacctattttgttgctcacgccagaatattacagtatgacattccttcttacaccgaccttatggtcaactcggcctctaattttgtaaaggaattatataatctgggagctcgtagagttgcagtactgggtgcaccgccgattggatgcgtgccatcacagagaactctggctggagggctaacaagaaagtgctcagaaaagtacaattacgcagccaggttgttcaattccaaactttcaaaggaacttgattccctcggtcacaacttgtcagataccaggatagtttacattgatgtttactcccctctgctcgatatcattgataactaccaaaaatatggctataaagttatggacagaggttgctgtggcacaggcaaactagaggttgcagtgttatgcaaccctttggatgacacttgttccaatgcttcggaatatgtcttttgggatagttatcatccaacagaaggagtgtacagaaagatcgtaaatcatgttcttgaaaagtacatggatcgattgttttgagctcgattaagtttgcccacaggaagtaattaatatgaattggttatgttgatgtcaactaagacaatgagtattttgatttgtcgagtttatgtaaaaaaaaaaaaaaaaaa

SEQ ID NO: 5054 - protein, 363 aa, Glycine max
  misc_feature: PFam Name: Lipase_GDSL; PFam Description: GDSL-like
  misc_feature: GI Number: 15054386; NR Description: family II lipase EXL3 [Arabidopsis thaliana] >gi|15222901|ref|NP_177718.1| family II
  misc_feature: GI Number: 26449364; NR Description: putative family II
  misc_feature: GI Number: 8778808; NR Description: T4O12.13 [Arabidopsis thaliana] >gi|25404994|pir||A96788 protein T4O12.13 [imported] -
  misc_feature: GI Number: 28827430; NR Description: putative family II extracellular lipase 1 (EXL1) [Arabidopsis thaliana] >gi|28393626|gb|AAO42232.1| putative family II extracellular lipase 1 (EXL1) [Arabidopsis thaliana]
  misc_feature: GI Number: 15054382; NR Description: family II lipase EXL1 [Arabidopsis thaliana] >gi|18410954|ref|NP_565120.1| family II
MALMQLTSSHVALLLRFIVIFALCYRTMALVKLPPNASSVPAVLAFGDSIVDSGNNNNIKTLIKCNFLPYGKDFQGGNPTGRFCNGKIPSDLIVEQLGIKEYLPAYLDPNLKSSDLVTGVGFASGASGYDPLTPKITSVISLSTQLDMFREYIGKLKGIVGESRTNYILANSLYLVVAGSDDIANTYFVAHARILQYDIPSYTDLMVNSASNFVKELYNLGARRVAVLGAPPIGCVPSQRTLAGGLTRKCSEKYNYAARLFNSKLSKELDSLGHNLSDTRIVYIDVYSPLLDIIDNYQKYGYKVMDRGCCGTGKLEVAVLCNPLDDTCSNASEYVFWDSYHPTEGVYRKIVNHVLEKYMDRLF

SEQ ID NO: 5055 - DNA, 1931 bp, Glycine max
  misc_feature (1)..(1931): Ceres cDNA ID no. 22005541
  misc_feature (1)..(1931): Ceres CLONE  ID no. 564351
  misc_feature (1)..(1931): Also known as  Ceres CDNA ID no. 24403359
agaaggtagtgttggtgggacaatgatgtcatttgctaggctcagtgcatctgtggattctactaagccgacaaagatgtcaacggtcaaactcaaacaatcagttgattccaagacctggatttctgatacctctgaaacttacaagcgggaactgccaacaaaatcatttgacagccaaaaagaaacagggaatgaagttctggtgaataggaacaaatcatcattggccaaggtcaaaccatcactccttccaaagtcccatacatctccatcagcgagacaagaaatttcatcaattaaggaggtccgatccccatcaaattcaacttccataaaggtgggaactccatcaaaatcaacttccaggaaggtggaagctccaccaaaatcaaccgccaataaaatggaagctccattaaaatcaacttccaataaagtgggaaatccatcaaaatcaacctccaaggtcaaagcttcatcaaaacgaactaccaatatggtgaaaacctcatcacagttatcttctctcaaaggtaaagaaatgaagttgtctgaaaaacatgtaaattctttaaattcaagcagtgtcagaaggaagcaaatatcttctatgaattcctcggaaggtgttggtggccaaagatatagtaagatcaagacagaaaaggaggtgacctcctccaattccaaagcagcttcaaaaaaactgatggcaccttcaaaggctttattaacccccagaccttcccttattagagttgcaagtataaattcaagaaagcataagagcctgaaaattgcttctcatcttaagaatcagcggagtgcccgaaaggttgaacatgaggaacacaacaacaacgaggtagaggaaaagactttgtacgtcatcaagatgggaagtgaaaacaaaacttcgctatctgatcaaaatgcaagctatgatgatgaatcataccttcctcagttgtcatcaccaaagtcttcagtatcctcaatttctaaatccttatcccaagaagaccaagaggaatctgaatatacaactagtgaatttgagcaggattctttttcaggaaaccatgaaactgaatgcattgaaaatgaggagacattggctgctgagaagaaaggcaagcccaaaaagggtggggttgtatattccaaagacaatgacaaccaaatgataaaattaaagttcagaaggggaaaagtggttgaaaatcaaactgagataagtagtccaaggaggcttaaatttcggagagcaagagtgccgagggagaaagccaatgttaacagcaatgtccgtaaaagctttgaaagaaatgtagcctgtgataacagcaatgatgctacaactggtccagagaaggttgttttgaggcatcaagacatgcaggaaaaaaaagatgcacagggattattaaataatgtaattgaggaaacagcaagtaaactggttgaagctcgcaagagcaaggttaaagcattggttggtgcctttgaaaccgtgatctctcttcatgagaaaaaaccttctgcagacacagtcagttgatggaatctggatagacattttctagctttttcatttgttttgtaaagaaatggtaggaaaataaaactgagctttggtagtagttgtgaagccaacaagctgaaggtacagcagaaagtaggatagatttgccttgagtttgtctttagaagctctgcatcatgcatgtagagttgaaaggagggttttgtattgcgaacttaccttaacttgcaccatatactttttgtttcattctgctttggatattgtcaatgatttgtagcttctgatttttaataaaatatcaaacagtgatgccagtgactttgtacttttagcctggaaaggaaaagtgctttgaacttgtgaaaaaaaaaaaaaaaaa

SEQ ID NO: 5056 - protein, 1931 aa, Glycine max
  misc_feature: PFam Name: CaM_binding; PFam Description: Plant
  misc_feature: PFam Name: RCSD; PFam Description: RCSD region
AGAAGGTAGTGTTGGTGGGACAATGATGTCATTTGCTAGGCTCAGTGCATCTGTGGATTCTACTAAGCCGACAAAGATGTCAACGGTCAAACTCAAACAATCAGTTGATTCCAAGACCTGGATTTCTGATACCTCTGAAACTTACAAGCGGGAACTGCCAACAAAATCATTTGACAGCCAAAAAGAAACAGGGAATGAAGTTCTGGTGAATAGGAACAAATCATCATTGGCCAAGGTCAAACCATCACTCCTTCCAAAGTCCCATACATCTCCATCAGCGAGACAAGAAATTTCATCAATTAAGGAGGTCCGATCCCCATCAAATTCAACTTCCATAAAGGTGGGAACTCCATCAAAATCAACTTCCAGGAAGGTGGAAGCTCCACCAAAATCAACCGCCAATAAAATGGAAGCTCCATTAAAATCAACTTCCAATAAAGTGGGAAATCCATCAAAATCAACCTCCAAGGTCAAAGCTTCATCAAAACGAACTACCAATATGGTGAAAACCTCATCACAGTTATCTTCTCTCAAAGGTAAAGAAATGAAGTTGTCTGAAAAACATGTAAATTCTTTAAATTCAAGCAGTGTCAGAAGGAAGCAAATATCTTCTATGAATTCCTCGGAAGGTGTTGGTGGCCAAAGATATAGTAAGATCAAGACAGAAAAGGAGGTGACCTCCTCCAATTCCAAAGCAGCTTCAAAAAAACTGATGGCACCTTCAAAGGCTTTATTAACCCCCAGACCTTCCCTTATTAGAGTTGCAAGTATAAATTCAAGAAAGCATAAGAGCCTGAAAATTGCTTCTCATCTTAAGAATCAGCGGAGTGCCCGAAAGGTTGAACATGAGGAACACAACAACAACGAGGTAGAGGAAAAGACTTTGTACGTCATCAAGATGGGAAGTGAAAACAAAACTTCGCTATCTGATCAAAATGCAAGCTATGATGATGAATCATACCTTCCTCAGTTGTCATCACCAAAGTCTTCAGTATCCTCAATTTCTAAATCCTTATCCCAAGAAGACCAAGAGGAATCTGAATATACAACTAGTGAATTTGAGCAGGATTCTTTTTCAGGAAACCATGAAACTGAATGCATTGAAAATGAGGAGACATTGGCTGCTGAGAAGAAAGGCAAGCCCAAAAAGGGTGGGGTTGTATATTCCAAAGACAATGACAACCAAATGATAAAATTAAAGTTCAGAAGGGGAAAAGTGGTTGAAAATCAAACTGAGATAAGTAGTCCAAGGAGGCTTAAATTTCGGAGAGCAAGAGTGCCGAGGGAGAAAGCCAATGTTAACAGCAATGTCCGTAAAAGCTTTGAAAGAAATGTAGCCTGTGATAACAGCAATGATGCTACAACTGGTCCAGAGAAGGTTGTTTTGAGGCATCAAGACATGCAGGAAAAAAAAGATGCACAGGGATTATTAAATAATGTAATTGAGGAAACAGCAAGTAAACTGGTTGAAGCTCGCAAGAGCAAGGTTAAAGCATTGGTTGGTGCCTTTGAAACCGTGATCTCTCTTCATGAGAAAAAACCTTCTGCAGACACAGTCAGTTGATGGAATCTGGATAGACATTTTCTAGCTTTTTCATTTGTTTTGTAAAGAAATGGTAGGAAAATAAAACTGAGCTTTGGTAGTAGTTGTGAAGCCAACAAGCTGAAGGTACAGCAGAAAGTAGGATAGATTTGCCTTGAGTTTGTCTTTAGAAGCTCTGCATCATGCATGTAGAGTTGAAAGGAGGGTTTTGTATTGCGAACTTACCTTAACTTGCACCATATACTTTTTGTTTCATTCTGCTTTGGATATTGTCAATGATTTGTAGCTTCTGATTTTTAATAAAATATCAAACAGTGATGCCAGTGACTTTGTACTTTTAGCCTGGAAAGGAAAAGTGCTTTGAACTTGTGAAAAAAAAAAAAAAAAA

SEQ ID NO: 5057 - DNA, 1424 bp, Glycine max
  misc_feature (1)..(1424): Ceres cDNA ID no. 22005542
  misc_feature (1)..(1424): Ceres CLONE  ID no. 566819
  misc_feature (1)..(1424): Also known as  Ceres CDNA ID no. 24403353
aagcatggaaaatatcaagggtcctagaccattaggtaatcatgatttcgaccaatcttaatttgtaaccgaattttattaactttttctcatacataaaaaaatttggccatgtatcctgaataaattgttcaaaatcatgcacatgtagtggtctaccaccatctaataatttctccataagtatagcaagtgaacaatgttacatgcaattttgagttatatacattttaatttcattacaaatcacttatcaatcaccatctcttcaaaaaattgatacaataggagctacttagaaatggagaaacaattcaaagtatttgtctatgaagagggggagcttccagttttccatgatggaccgtgcagcagcatatactccacagaggggagcttcatccatgctattgaaatgaatgagcattttcgaacaagagatcccaagaaagcaaatgtgtttttccttccttttagcatagcatggatggttcgatatgtgtacataaggaattcatacgattttggccccataaaaagaactgtcagggactatgtcaatgtcattgctacaagatacccctattggaatcgaagcctcggagctgatcacttcatgctctcttgccatgattgggggccagagacttcaaaatccataccttacctgcgtaagaactctattcgtgtactttgcaatgccaacacctctgaaggattcgaccctataaaggatgcttcatttcctgaaattaatctccaacctggtttaaaagatagcttcgttggtggaccgcctgcatttaaacgttcaattttggccttctttgctggggggaatcatggccccattaggccaattcttcttgagcattgggaaaacaaggatgaagatattcaagttcacaagtacctcccaaagggtgtttcttactatggcatgctgaggaatagcaagttttgcctttgtcctagtgggtatgaggtggctagccctagagtggtggaggcaatttacacagggtgtgttcctgtgctcatttcggagcactatgttcctccttttagtgacgttttgaattggaagatgttttcagttaatgtttcagtgaaagaaattcccaacttgaaggacattttgacgagtatttctccaaggcagtatataagaatgcaaaaaagagtgggacaaattcggagacactttgaggtacattctccacccaagcgatacgatgtgtttcatatgatacttcattctgtgtggcttaggagactcaacttcagagtccatgatgatatcaatgattttttaagtggcaataattgataaattacttcatacggattctctttggcaatattgtaaaatccataggcaagaaaaatacaactatttaaaaaagaaaaaaaaaaaaaaaaaa

SEQ ID NO: 5058 - protein, 342 aa, Glycine max
  misc_feature: PFam Name: Exostosin; PFam Description: Exostosin family
  misc_feature: GI Number: 15237526; NR Description: exostosin family protein / pentatricopeptide (PPR) repeat-containing protein [Arabidopsis
  misc_feature: GI Number: 50934821; NR Description: putative pectin-glucuronyltransferase [Oryza sativa (japonica cultivar-group)] >gi|34394611|dbj|BAC83913.1| putative pectin-glucuronyltransferase [Oryza sativa (japonica
  misc_feature: GI Number: 51477380; NR Description: EXO [Cucumis melo]
  misc_feature: GI Number: 15239388; NR Description: exostosin family protein
  misc_feature: GI Number: 15241301; NR Description: exostosin family protein
MEKQFKVFVYEEGELPVFHDGPCSSIYSTEGSFIHAIEMNEHFRTRDPKKANVFFLPFSIAWMVRYVYIRNSYDFGPIKRTVRDYVNVIATRYPYWNRSLGADHFMLSCHDWGPETSKSIPYLRKNSIRVLCNANTSEGFDPIKDASFPEINLQPGLKDSFVGGPPAFKRSILAFFAGGNHGPIRPILLEHWENKDEDIQVHKYLPKGVSYYGMLRNSKFCLCPSGYEVASPRVVEAIYTGCVPVLISEHYVPPFSDVLNWKMFSVNVSVKEIPNLKDILTSISPRQYIRMQKRVGQIRRHFEVHSPPKRYDVFHMILHSVWLRRLNFRVHDDINDFLSGNN

SEQ ID NO: 5059 - DNA, 1316 bp, Triticum aestivum
  misc_feature (1)..(1316): Ceres cDNA ID no. 22005543
  misc_feature (1)..(1316): Ceres CLONE  ID no. 568127
  misc_feature (1)..(1316): Also known as  Ceres CDNA ID no. 25892720
cttcctacattcctcgtcctcctcagtctctcccctctcatcccccaacaaaggatccctcctcttcacactccgtctcgccacattcggagctcggatccaaccactgcttatcccacccgatccctcccaaatcacccacgcacccgattcgctcctcccctgcaaagagaggtctatacccctaccttgattcggcggccggcgccatggcgagcggcagcgagcagccgcaggcggagaccgagcccgaggcggtggagctcgtgctgttccaggtcgccgagtgctacgtctatctgatacctcctaggaagacggccgcctcttacagggctgatgagtggaatgtcaacaaatgggcttgggaaggggcacttaaggttgccagcaagggagaagaatgtatcatcaaactagaagacaagagcactggtgagctgtatgctagggcatttctgagagaaggcgaaccacatccggtggaagctgtaattgatagcagcagatattttgtacttcgcgttgaagagaatatagatgggcgtcagcgtcatgcttttataggtttaggcttccgtgaaagaactgaagcatatgacttccaagctgctctacatgaccatatgaaatatctaaacaagaagaagaccgctgaagagatggtgcagcactatgagaatacgtcatcagtggattatagcctcaaagaaggggaaactttagttcttcaactaaaaaataaagaaagtggcagcaagacaaaatctgcatttttcgagcaaggcctgaacaagctgtcgttcaatgaaaaagcaaacaccaaggaggccacagtgtccctcaaactcccaccacctccaccctcacccgtgtctccaactgattctggagttgccatgtcccctttcaaagcagaatttccttcccaggaacaaccaggcaccggcgatgccagagacgccgccgctcctttcaaagcagaatttccttcacaagaagaagcactggatgataccgtggaagctagagcggaagctgctcctcgtaatcaaccagccgcagcagacaagagcaaacaaggaagcgtggatgatgagtttgactttggggacttccaggctgctgcttgaatcatgtatcctgtacatacgtcaactttattacgtggacacatacatgtgtcctttctttttcttggatctcccgtcagttgtgacttttttttcgccacccgagttgttgtacagagagctgtcatatgataagccgtataaattaagaatacatatataagccgaaaaaaaaaaaaaaaa

SEQ ID NO: 5060 - protein, 307 aa, Triticum aestivum
MASGSEQPQAETEPEAVELVLFQVAECYVYLIPPRKTAASYRADEWNVNKWAWEGALKVASKGEECIIKLEDKSTGELYARAFLREGEPHPVEAVIDSSRYFVLRVEENIDGRQRHAFIGLGFRERTEAYDFQAALHDHMKYLNKKKTAEEMVQHYENTSSVDYSLKEGETLVLQLKNKESGSKTKSAFFEQGLNKLSFNEKANTKEATVSLKLPPPPPSPVSPTDSGVAMSPFKAEFPSQEQPGTGDARDAAAPFKAEFPSQEEALDDTVEARAEAAPRNQPAAADKSKQGSVDDEFDFGDFQAAA

SEQ ID NO: 5061 - DNA, 1668 bp, Triticum aestivum
  misc_feature (1)..(1668): Ceres cDNA ID no. 22005544
  misc_feature (1)..(1668): Ceres CLONE  ID no. 568963
  misc_feature (1)..(1668): Also known as  Ceres CDNA ID no. 24408504
ctcctattctgccggcggcggtcggtcgctgcaggctgcatctagtttggtcctagcgtagccgcggaggacctccaggcggcggggcaccttcgtttcgtcgctctctcctctgcatcattccattcctggaggtccaagtcgtcctctccttcctcgctcgccggtcaagatctccacttcgcactcgcgggcatcctcgggagagcaaacaagaagaagaagaagaaggactggactgccgtgtaggtgtagtgaagatccctttgaccagtaacgaacgaatccatatctgctgcttgccgtgagggatggccggaagcggcctgtgggtagttggattggcttcccttcttgcactccctgggatattcgtctccgtctccgtcgaggccagcccgggagatgctgatccgcactacagaacttgtgtgggggagtgtcagaatacggggattattggaggcaacatcatcagtcactgtcagtcccgagagaacgacagcatatctgctggaagttcttggtacacacaggaggctcttcgcgtgcagtggaagcaactaaactgtatgacagactgccgctactactgcatgatgcgaagagaagaggaacggcgattaggtgggctgagccctattcaatatcacggaaaatggcccttcaaacgtgtttctgtcttccaggaacccctttcagctgcactgtctgctctcaacctattgatgcacttcactggctggctttcgttcttcctgctagtgaaatacagattacctcttagacctcagacgaagaagacgtactacgaatacactggcttatggcatatctatgcaatattatcaatgaatgcatggatctggagctctgtattccataccagggatattgacttgactgagaaattggattactcttcagctgtggccgtacttggctactctttaatccttacactgctaagaatttttaatgtcaaggagggggctaccagggtgatgtttgctgcacctattctagcattcgtcacaacacacatcttgtatctaaacttctacgagcttgactacggatggaacatgaaagtttgtgtggcgatgggagtggttcaaattgtcgcatgggcaatctgggctggtgtgacccatcatccgtcacggttgaagctttgggtcgttgtgtttggaggagctctagctatgcttcttgaggtgtttgactttcctccatacaaggggtatgccgatgcgcactcgctgtggcacgcgagcaccgttcccctcacctatctttggtggagcttcattaaagatgatgcacagttccgcacctccacactcacactggttaagaaggccaggtgaattaaaggtcattatgttgttcggttctctcaaggcaacacaagcaaaacctcggtatgctcagtattccctgggttcgatcaggacgacaaatcattcgtctttgggtgtcacggttttggtctgcaaactcagcttctcgtttctgcggctctagccctccagacttttgttttgatcgatatgaggaatagttgtgtagaagaaaaaatgacattatctttttccgtgcctgttgagacagttgagcctgtgagtttcaatagaagcttatatgaagccaaaaaaaaaaaaaaaa

SEQ ID NO: 5062 - protein, 352 aa, Triticum aestivum
  misc_feature: PFam Name: Per1; PFam Description: Per1-like
  misc_feature: GI Number: 25372701; NR Description: F19K19.12 protein - Arabidopsis thaliana >gi|42571505|ref|NP_973843.1| Per1-like family protein [Arabidopsis thaliana] >gi|15219283|ref|NP_173104.1| Per1-like family protein
  misc_feature: GI Number: 20147283; NR Description: AT5g62130/mtg10_150 [Arabidopsis thaliana] >gi|15294204|gb|AAK95279.1| AT5g62130/mtg10_150 [Arabidopsis thaliana] >gi|18424554|ref|NP_568951.1| Per1-like protein-related
  misc_feature: GI Number: 51262022; NR Description: MGC84367 protein
  misc_feature: GI Number: 37181999; NR Description: AGLA546 [Homo sapiens] >gi|32949296|gb|AAH10652.2| CAB2 protein [Homo sapiens]
  misc_feature: GI Number: 51766413; NR Description: RIKEN cDNA D430035D22
MAGSGLWVVGLASLLALPGIFVSVSVEASPGDADPHYRTCVGECQNTGIIGGNIISHCQSRENDSISAGSSWYTQEALRVQWKQLNCMTDCRYYCMMRREEERRLGGLSPIQYHGKWPFKRVSVFQEPLSAALSALNLLMHFTGWLSFFLLVKYRLPLRPQTKKTYYEYTGLWHIYAILSMNAWIWSSVFHTRDIDLTEKLDYSSAVAVLGYSLILTLLRIFNVKEGATRVMFAAPILAFVTTHILYLNFYELDYGWNMKVCVAMGVVQIVAWAIWAGVTHHPSRLKLWVVVFGGALAMLLEVFDFPPYKGYADAHSLWHASTVPLTYLWWSFIKDDAQFRTSTLTLVKKAR

SEQ ID NO: 5063 - DNA, 1332 bp, Triticum aestivum
  misc_feature (1)..(1332): Ceres cDNA ID no. 22005545
  misc_feature (1)..(1332): Ceres CLONE  ID no. 569243
  misc_feature (1)..(1332): Also known as  Ceres CDNA ID no. 24410119
acaatccacggccaccagctccagcggccttcacgtacgtagctactgttactcgcagagagcagggacgacagatccgacaaggagatcaatggagatgactgttaacgggagggacaccgagcagcaccaccaccttggcctcggcctcggcctcgggctcagtctcggcatgtccggtacgacgtctcccgtcgagccggcggcgccccagcgtgctctgaccgctgctgcgccgtcgacgctggggcggcagcagcagcagtcctggaatggcgccggcctcttctatccggcctcctccggcgagcagcctcgctcgcatgcagatgaccggaggctggcggcgttggcgtgccacgagatgccgtccctgcgcgggatcgacgtcaaccgggcgccggccacggggggcgcgaggggcagctgcggcgccagcgaggacgaggagcccggcgcgtcgtcgcccgacagcacgctgtccagcctcagcggcaagcgcggcgcgccgacgaggagcggcggcggggagcaggagcgcgccggcgcgggcagcgacgacgaggacgactccgggaccggcggcgccgggtcgcgcaagaagctccgcctgtccaaggaccagtccgccgtgctcgaggacagcttcaaggagcacagcaccctcaaccccaagcagaaggcggcgctggcgaggcagctggggctgcggccgcggcaggtggaggtgtggttccagaaccggagggcgaggacgaagctgaagcagacggaggtggactgcgagtcgctcaagcgctgctgcgagacgctgaccgaggagaaccgccggctgcagcgggaggtgcaggagctgcgcgcgctcaagctgctcgccccgccggcgccgcacctctacatgcgcgcgccgccgcccaccacgctcaccatgtgcccctcctgcgagcgcgtcgcgccctccggcaagccggccgtcgacgagagccgcgccgccatggtgacccgggccgtgccgaccgggccgtggggccccgtcccggtgatgcccgtgttcctgggcaggccggcccagaggtcatgatgaactaattggtgtgtcatgtcatgcgttagtgagttgggagcttaccatccagtggccctacttgatggagtatctataggaagaacaggcatagtaactaggatagctggcgaaagagaggaagtaactagggataggatcctgttttcttttgtttataagtaagtacatgcatgtttagtttgaacttagaaacttttggtgttccgtttgttcaaaaaaaaaaaaaaaaaaaaaaaaaaaaaaaa

SEQ ID NO: 5064 - protein, 329 aa, Triticum aestivum
  misc_feature: PFam Name: HD-ZIP_N; PFam Description: HD-ZIP protein N terminus
  misc_feature: PFam Name: Homeobox; PFam Description: Homeobox domain
  misc_feature: PFam Name: HALZ; PFam Description: Homeobox associated
  misc_feature: GI Number: 7446297; NR Description: DNA-binding homeotic
  misc_feature: GI Number: 6634483; NR Description: DNA-binding protein [Oryza sativa (indica cultivar-group)] >gi|6635777|gb|AAF19980.1|
  misc_feature: GI Number: 37536862; NR Description: homeodomain leucine zipper protein hox1 [Oryza sativa (japonica cultivar-group)] >gi|13569986|gb|AAK31270.1| homeodomain leucine zipper protein hox1
  misc_feature: GI Number: 25453563; NR Description: homeobox protein HAT3 [imported] - Arabidopsis thaliana >gi|549889|gb|AAA56904.1|
  misc_feature: GI Number: 30984526; NR Description: At3g60390 [Arabidopsis thaliana] >gi|20466199|gb|AAM20417.1| homeobox-leucine zipper protein HAT3 [Arabidopsis thaliana] >gi|7287987|emb|CAB81825.1| homeobox-leucine zipper protein HAT3 [Arabidopsis thaliana]
MEMTVNGRDTEQHHHLGLGLGLGLSLGMSGTTSPVEPAAPQRALTAAAPSTLGRQQQQSWNGAGLFYPASSGEQPRSHADDRRLAALACHEMPSLRGIDVNRAPATGGARGSCGASEDEEPGASSPDSTLSSLSGKRGAPTRSGGGEQERAGAGSDDEDDSGTGGAGSRKKLRLSKDQSAVLEDSFKEHSTLNPKQKAALARQLGLRPRQVEVWFQNRRARTKLKQTEVDCESLKRCCETLTEENRRLQREVQELRALKLLAPPAPHLYMRAPPPTTLTMCPSCERVAPSGKPAVDESRAAMVTRAVPTGPWGPVPVMPVFLGRPAQRS

SEQ ID NO: 5065 - DNA, 1333 bp, Triticum aestivum
  misc_feature (1)..(1333): Ceres cDNA ID no. 22005546
  misc_feature (1)..(1333): Ceres CLONE  ID no. 569607
  misc_feature (1)..(1333): Also known as  Ceres CDNA ID no. 24408508
acctcgctcgatccgcctgcacaaccgacgctgccccgatccccaagaatccgatccagggatccacgcccatggccgccgtcaccaagaagaagaaggtcatcatcgacaccgacccagggatcgatgacgccatggccatcttcgtcgcgctgaggtcgccggagctggaggtggtgggcctcaccaccatcttcggcaacgtctacaccgccctcgccacccacaacgcgctgcacctcctggagaccgctgggaggaccgacatccccgtcgcagaggggtcccatgtaacaatcaagaaagccaccaagctgcggattgccagcttcgtccatggttcggatggcctcggcaaccagaacttccctccgccggccggcaaggcggtggagcagtccgccgccgccttccttgttgagcaggcgaatctctaccccggacaggtcaccgtcgttgccctcggccccctcaccaaccttgcgctggctgtcgagcttgacccttctttccccaagaagattgggcagattattatcctgggtggcgcatattcagttaatggaaatgtgaaccctgcagccgaggcaaatatatttggtgatcctgatgcggctgatatagtttttacctgcggcgcggatattttggccatcggaattaacatcacgcaccaagtactcctttctgatgttgaccggaagaagcttgaagagtccgatagcaaatatgctcgctacttgagcaatatactgggttattattatgattatcacttggatgcctactccataacaggagtatatcttcatgatccgacaactcttcttgccgccgtagatccatcgctgatgacttacacggaaggagtggtgagggttcagacggatggaatcacaaagggtctcaccgttttcgacaataccaagaaaacgtatggggagataacagcgtggtgtggtaagccgactgtgaaggttgctgtcacggtcgatgcccccgctgtcgtggagctcattatgcagaggcttctcacggacgactgaaacatttcgtttgcaatgctgcagtcaagattcaagaacatacttgtcaatgttgcattatgtactgtctaccttcgggggctgagatgaaccatgggcctcttcttttgtagttcaacacttgaacatttacacttgtagcacaacacttgaatatttacacttgtagtccaacacttaagcattttacacttcaggcagaaagaccagattatagttcatttttcacttttcagttctcaatgcacatctgaataaattgtttggtgtacaaaaaaaaaaaaaaa

SEQ ID NO: 5066 - protein, 324 aa, Triticum aestivum
  misc_feature: PFam Name: IU_nuc_hydro; PFam Description: Inosine-uridine
  misc_feature: GI Number: 41469366; NR Description: putative inosine-uridine preferring nucleoside hydrolase, 3'-partial (with alternative
  misc_feature: GI Number: 41469367; NR Description: putative inosine-uridine preferring nucleoside hydrolase (with alternative splicing) [Oryza
  misc_feature: GI Number: 46560602; NR Description: putative inosine-uridine
  misc_feature: GI Number: 50948453; NR Description: putative inosine-uridine nucleoside N-ribohydrolase [Oryza sativa (japonica cultivar-group)] >gi|42407950|dbj|BAD09089.1| putative inosine-uridine nucleoside
  misc_feature: GI Number: 52011147; NR Description: COG1957: Inosine-uridine
MAAVTKKKKVIIDTDPGIDDAMAIFVALRSPELEVVGLTTIFGNVYTALATHNALHLLETAGRTDIPVAEGSHVTIKKATKLRIASFVHGSDGLGNQNFPPPAGKAVEQSAAAFLVEQANLYPGQVTVVALGPLTNLALAVELDPSFPKKIGQIIILGGAYSVNGNVNPAAEANIFGDPDAADIVFTCGADILAIGINITHQVLLSDVDRKKLEESDSKYARYLSNILGYYYDYHLDAYSITGVYLHDPTTLLAAVDPSLMTYTEGVVRVQTDGITKGLTVFDNTKKTYGEITAWCGKPTVKVAVTVDAPAVVELIMQRLLTDD

SEQ ID NO: 5067 - DNA, 1386 bp, Triticum aestivum
  misc_feature (1)..(1386): Ceres cDNA ID no. 22005547
  misc_feature (1)..(1386): Ceres CLONE  ID no. 569699
  misc_feature (1)..(1386): Also known as  Ceres CDNA ID no. 24412689
gttagctcaaatccaactccaacaaccgccgacctcaccgcccggaattctatggcctacacctcctccctccacctctccaagcacctcctcctccccaagccccaccgcgccaggccttcctcctccaggtcgccgtccttcgtccgggcggccagggtcgtcaacggcgccccgcacgtcaacgggcactccaagaaggcgcccaacggcaaggtacagatcaacggcgacggcaagaagggggccggcgtcgtcaacgggaagacgcacgtgaacggccatgaccggatccacctgtcggtgaccacgggcggcgggggccaggacgggacgggcctccgcgtggcgtaccagggcgcgccgggcgcgtacagcgagttcgcggccaagacggcgctgcccgggtgcgagaccgtgccgtgccgcgccttcgcggacgcgctggcggccgtggaccgcggcctggtcgaccgggccatcctccccgtggagtccaccatggagggcaccgcgctgcggaactacgacctcctgctgcggcacgacctggtggtggcgcaggagatcaacctcttcgtgcactactgcctcctggccatgcccggggtgcgcgccaccgaggtgcgccgggtcatcagccaccccatggcgctcgcgcactgcggccgcgccctcgcgcgcctcggcgtcgaccgcgagccggtcgaggacacggccggcgccgtcgagatgctgcgctccaacatgatgctcgacacggccgccatcgccagcccgcgcgccgccgacctctacggcctcgacgtcctggcgcacggcctgcaggacgagtcctggaacgtcacccgcttcctgctgctctccaagccgccgtcgccggtggcggtccccgtggacgcggacgccaagaccagcatggtggtcgcgcaccggggcgggtccatggcggtggtgctcaaggtgctctccgccttctcctcccgcaacatcaacatgtccaagctggaggtcatcaacaacgaagggggcgtcggcgagccgcggcccccggtgatgatcctggacacgggcgcccgcggcgcgccgacgctgcgcgcgttcccgcacgtcctctacgtggactgcgagggcgccgccgacgacccgctcgtccgcgaggccatcaaggagatcgagaaattcgccgtgttcgtccgagttcttggctgctacgccgcggacaccaacgtctacgatctgcaatgaggagaacagaagaatgatcctcccaccatacacgtgaagtggtcgaattagctagttcggcacaatcgaattggaattggaattggacctggaaatttccattctgtaaaaaaaaaaaaaataaaaaaaaaaaaaaaa

SEQ ID NO: 5068 - protein, 398 aa, Triticum aestivum
  misc_feature: PFam Name: PDT; PFam Description: Prephenate dehydratase
  misc_feature: PFam Name: Keratin_B2; PFam Description: Keratin, high
  misc_feature: PFam Name: Pyr_redox_2; PFam Description: Pyridine
  misc_feature: PFam Name: Peptidase_S8; PFam Description: Subtilase family
  misc_feature: PFam Name: ACT; PFam Description: ACT domain
  misc_feature: GI Number: 37536214; NR Description: putative chorismate mutase/prephenate dehydratase [Oryza sativa (japonica cultivar-group)] >gi|27311276|gb|AAO00702.1| putative chorismate mutase/prephenate dehydratase [Oryza sativa (japonica
  misc_feature: GI Number: 45935145; NR Description: prephenate dehydratase
  misc_feature: GI Number: 21593283; NR Description: putative chorismate
  misc_feature: GI Number: 38347597; NR Description: OSJNBa0042I15.10 [Oryza
  misc_feature: GI Number: 52077190; NR Description: putative prephenate dehydratase [Oryza sativa (japonica cultivar-group)] >gi|52076143|dbj|BAD46656.1| putative prephenate dehydratase [Oryza
MAYTSSLHLSKHLLLPKPHRARPSSSRSPSFVRAARVVNGAPHVNGHSKKAPNGKVQINGDGKKGAGVVNGKTHVNGHDRIHLSVTTGGGGQDGTGLRVAYQGAPGAYSEFAAKTALPGCETVPCRAFADALAAVDRGLVDRAILPVESTMEGTALRNYDLLLRHDLVVAQEINLFVHYCLLAMPGVRATEVRRVISHPMALAHCGRALARLGVDREPVEDTAGAVEMLRSNMMLDTAAIASPRAADLYGLDVLAHGLQDESWNVTRFLLLSKPPSPVAVPVDADAKTSMVVAHRGGSMAVVLKVLSAFSSRNINMSKLEVINNEGGVGEPRPPVMILDTGARGAPTLRAFPHVLYVDCEGAADDPLVREAIKEIEKFAVFVRVLGCYAADTNVYDLQ

SEQ ID NO: 5069 - DNA, 1204 bp, Triticum aestivum
  misc_feature (1)..(1204): Ceres cDNA ID no. 22005548
  misc_feature (1)..(1204): Ceres CLONE  ID no. 569811
  misc_feature (1)..(1204): Also known as  Ceres CDNA ID no. 24411894
cactgccctgcagcctctccttctcaactggctcgcaccttcttcccttccttccttccttccctttacacaccccttctctctctctctctctctctctctctctctctctagctacccctctctctaattgggtagtacactagttactccagtagccaagaagcagctagctagggagagatcagcgtcgttcctgccggccatggcgaacaccacgcgcaaggaggaggggccggacaaacgcgtcaatcagcagcaggggagcaccaagctctactccaggatgctgtccaaggacgtagccatcgccgtcccgtccttccgggtgtactacggcgtcgcctcggccggctccgtgcccttcctgtgggagtcgcagccgggcacgcccaagagctcgccctccgccgccgcgctcccgcctctcacgccgccgccctcctactacgcggccggcgacaagggcggctccaagaggggcggcgccggcgcgtccgggaggcgctggcccggcggcgtcatcgccctcttccggaggccccggcgcaggacgtcgccgtgctcctcctcctccatctcctggtcgtcctcgtcgtccaccgcatcgtccatgtcgccggtgttcacggtgcagtcttcgcccttcgctgcacggggctccgcaggcgcccaccgacgagcgttctcggccggcgacgtcttcgaggatgcggcggcgccgtcgagctgcttcgggacggaccgagagtgcgacaggagggtggtgaagggctgcggcgtcgccgtggccgtccggaacgcgctggccaccgtcgtgggccacaagcccggcggccgagccaccagcgcgatggcctagagaggacaggagccctgtcctggctacagaaagtagcagtgtggcatgtttaattttctaaatacccggggtgtggtttgcattttgtgctagtataaatgtacttgacctgcgttacgtacgtgtcatttccatgtcatgcatggcaaggaagaaaagtgtaaacataacgagtaatattatgtggtggtgtatttgtatgtgcaaccgtatatacgcgcatgtatacggttacttggtcgtgtcaggcttgtgtactgcaaatatgtgttcttgttgtccagcctaatgaagagtgaggtaatgcaaatgaatattttcagtcgaaaaaaaaaaaaaaaa

SEQ ID NO: 5070 - protein, 218 aa, Triticum aestivum
  misc_feature: PFam Name: Pyr_redox_2; PFam Description: Pyridine
  misc_feature: PFam Name: Drf_FH1; PFam Description: Formin Homology Region 1
  misc_feature: PFam Name: MCPVI; PFam Description: Minor capsid protein VI
  misc_feature: PFam Name: FH2; PFam Description: Formin Homology 2 Domain
  misc_feature: PFam Name: 7tm_1; PFam Description: 7 transmembrane receptor
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 21537311; NR Description: unknown [Arabidopsis thaliana]
  misc_feature: GI Number: 34907876; NR Description: P0031D02.26 [Oryza sativa (japonica cultivar-group)] >gi|14587351|dbj|BAB61252.1| P0439E11.1 [Oryza sativa (japonica cultivar-group)] >gi|21104604|dbj|BAB93197.1| P0031D02.26 [Oryza sativa (japonica
  misc_feature: GI Number: 37534496; NR Description: putative cell wall protein [Oryza sativa (japonica cultivar-group)] >gi|31432175|gb|AAP53837.1| putative cell wall protein [Oryza
  misc_feature: GI Number: 45773858; NR Description: At3g56260 [Arabidopsis thaliana] >gi|44681332|gb|AAS47606.1| At3g56260 [Arabidopsis
MANTTRKEEGPDKRVNQQQGSTKLYSRMLSKDVAIAVPSFRVYYGVASAGSVPFLWESQPGTPKSSPSAAALPPLTPPPSYYAAGDKGGSKRGGAGASGRRWPGGVIALFRRPRRRTSPCSSSSISWSSSSSTASSMSPVFTVQSSPFAARGSAGAHRRAFSAGDVFEDAAAPSSCFGTDRECDRRVVKGCGVAVAVRNALATVVGHKPGGRATSAMA

SEQ ID NO: 5071 - DNA, 1676 bp, Triticum aestivum
  misc_feature (1)..(1676): Ceres cDNA ID no. 22005549
  misc_feature (1)..(1676): Ceres CLONE  ID no. 570294
  misc_feature (1)..(1676): Also known as  Ceres CDNA ID no. 25088251
agcgagtgagctcccacctccctccctcccctcctctctgctcccaccaccaaaccctccgatccaaaccctctctcacctcgcatgcggccgcgccccccgaggcggcggcgcagctgaccccttcccaccgccgctcccggagcccgccggcatgggcggggtcacgtccaccatcgccgcgcgcttcgccttcttcccgcccacgccgccctcctacacgctcgtcgccgacgcggccaccggccgcctcctcatccccgagatctcccggccccccgcgcgccgccggaggcgggacggcggcggggactcctcctcaggtgccgccgcagcagccgaggaggaggacgccacggaggtggtgcgcctccgcacgcgccgcgggaacgagatcgtcgccgtctacgtgcgccacgcgcgggcctccgccacgctgctctactcccacggcaacgccgccgacctcggccagatgtacggcctcttcgtcgagctcagccgccgcctccgcgtcaacattttcgggtatgattatgctggttatgggaggtctacagggaagcccactgagtataatacatatgcagacattgaagcagcatataactgcctcaaggaaaaatatggtgtgccagatgaggatataattttgtatggacaatctgttggaagtggtccaaccattgatcttgcttcacggttgccaaatttgcgagctgtggttcttcacagtcctattttatctggactgagagtgctatatccagtcaaaaaaactttttggtttgacatttacaagaatgtcgacaaaatcagcctggtgaattgtccagttcttgtcattcatggcacgtcagatgatgttgttgattggtcccatggaaagcagctatgggagctttgcaaggtgaaacattcgcctttgtggctaagtggcggtgggcactgcaaccttgagctgtatcctgactacatcaggcacttgaagaagtttgtgtcgagccttggcaaaaaatcaacgaaacctgacttgaaagagttaccagcaacagaagacacatctcgcaaagacgcagaatctgtgtcctcggacaaaccccaagaagctgcaaagtgccgacagatctcgcggaagagcttagatagtagagttgggaaatccaaaacggtggatgttcctgaaaagccacgaatgagctcagatgacgttgacaagtttaggaggagaagatgcttggtttggtgatctatgatatgacgtctgcacagttcatggagtagtttccgaacaccatggaatggggatcaagcaactgtgtcatactgtatagcgaggaacaacgccgacagttcccgcagtagagggataatagctgtgttaaatgtgggagaagaagaatgaggacgctggtgaataagctgttatttatcaaagagggtacgtctcaacgtggtaactttctcggttaattaacctgtattgcaacccccagtggtggtaggatttccatcatgtaaaagtgtaccgtgttattgtctgtaatcacgagggacaaggatagaacatttgcggccactttgcggcgcagtctaaagtcttggagcaatcacaagaagcaacatattctagtctggatatgcaaatatagtgttcatgaaaaaaaaaaaaaaaa

SEQ ID NO: 5072 - protein, 364 aa, Triticum aestivum
  misc_feature: PFam Name: Abhydrolase_2; PFam Description:
  misc_feature: PFam Name: Abhydrolase_1; PFam Description: alpha/beta
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: GI Number: 34911338; NR Description: P0519D04.38 [Oryza sativa (japonica cultivar-group)] >gi|18844910|dbj|BAB85379.1|
  misc_feature: GI Number: 50905845; NR Description: putative Cgi67 serine protease [Oryza sativa (japonica cultivar-group)] >gi|46390967|dbj|BAD16480.1| putative Cgi67 serine protease [Oryza
  misc_feature: GI Number: 51535771; NR Description: Cgi67 serine
  misc_feature: GI Number: 34905260; NR Description: putative TPA: Cgi67 serine protease precursor [Oryza sativa (japonica cultivar-group)] >gi|29170589|dbj|BAC57808.2| putative TPA: Cgi67 serine protease
  misc_feature: GI Number: 55242759; NR Description: ENSANGP00000010159
MGGVTSTIAARFAFFPPTPPSYTLVADAATGRLLIPEISRPPARRRRRDGGGDSSSGAAAAAEEEDATEVVRLRTRRGNEIVAVYVRHARASATLLYSHGNAADLGQMYGLFVELSRRLRVNIFGYDYAGYGRSTGKPTEYNTYADIEAAYNCLKEKYGVPDEDIILYGQSVGSGPTIDLASRLPNLRAVVLHSPILSGLRVLYPVKKTFWFDIYKNVDKISLVNCPVLVIHGTSDDVVDWSHGKQLWELCKVKHSPLWLSGGGHCNLELYPDYIRHLKKFVSSLGKKSTKPDLKELPATEDTSRKDAESVSSDKPQEAAKCRQISRKSLDSRVGKSKTVDVPEKPRMSSDDVDKFRRRRCLVW

SEQ ID NO: 5073 - DNA, 1460 bp, Triticum aestivum
  misc_feature (1)..(1460): Ceres cDNA ID no. 22005550
  misc_feature (1)..(1460): Ceres CLONE  ID no. 570935
  misc_feature (1)..(1460): Also known as  Ceres CDNA ID no. 24412679
aatccaaatcgccgcctcccaccaccaatccgtccctcacatggctgcgctccactcggcggcggggccgcgtagtccgtctgcgtagcgatcggaacgtagtgtttcggtggtgcgcgccgggttgccttatcggagttcgtgggtgttgactatcagggcgagcggatggacgccgacggtcgcctccggcgcgcgctcgccgccttcgggggcggagacgtgtgggacctcgtcgatgccgcgctcgccgcggccgcgccagccgacctccgcgcgcgtcgtgacgggatcgtggagcggctctacgccggggcccgctgccgcaattgcgatgcccccgagagtccaccgcagccgccgcgtcagccggccgaggccgcttctccggcctggcaggaggaggaggaggaggaggaggaggtggccgacgtggatggcctcggcctggaggaggagaccgacgagggcggcggcttggagagcaagatcctggcgatcaaggatttcttggaggaccccgaccagtcggaggaggagctcgtgagcctgctgcagaacctggcagacatggacatcacctacaaggctctccaggagacggacatcggccgacatgtgaatggcctgcgcaagcacccttcgggtgacgtccggcagttagtgaagctgctcgtcaggaaatggaaggagatagtggacggctgggtgcggctccacaactctggtggtgacggtggaaattcgatcctaactgatggtgactctcctgagaagactcaaggcaaaagctaccaaaatgcccgggtttcagacttcaagtatacgcccagcccaccacagaggcacagtggtttgagttcagagcggtctaggaataacaatgggttcgagtcgacactggagaggcatagagcaagcccagctcctacgtatcatacgaagcagaacaatggcaataactattcaactacttcgtcatctgctccagctagggcgatgagggagcagaaggataatcatttggacgagaagctcgattcagccagaaagaggcttcaagaaaattaccaggaagcacaaaatgcgaaaaaacagaggacaatgcaagtgctggatatccacgacatacccaagccgaaaaataaaaacaccttcatccgcaagcctggtggaggtggcctccctggccgacatcggtgacctggtgaacatgcaaattcttagccgcggcaaggttcaaaatgaaaaataaattgagcacgaaaggtttatgtttgttctttttttagttacactctggtccgctgaaatattgtccagcacaaccaagtcaagatataatactagtactactgataaaaggaccaaggttatatatttgagaatttgtgctgtagcttgttttttttaagaggtctcttgaatgtacctggaagtattcaaaaaaaaaaaaaaaa

SEQ ID NO: 5074 - protein, 344 aa, Triticum aestivum
  misc_feature: PFam Name: GRP; PFam Description: Glycine rich protein family
  misc_feature: PFam Name: Collagen; PFam Description: Collagen triple helix
  misc_feature: GI Number: 62734379; NR Description: AT5g09850/MYH9_6 [Oryza
  misc_feature: GI Number: 20147241; NR Description: AT5g09850/MYH9_6 [Arabidopsis thaliana] >gi|16648730|gb|AAL25557.1| AT5g09850/MYH9_6
  misc_feature: GI Number: 18416107; NR Description: transcription elongation
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 66776365; NR Description: PE-PGRS family protein [Anaeromyxobacter dehalogenans 2CP-C] >gi|66857891|ref|ZP_00401930.1| PE-PGRS family protein
MDADGRLRRALAAFGGGDVWDLVDAALAAAAPADLRARRDGIVERLYAGARCRNCDAPESPPQPPRQPAEAASPAWQEEEEEEEEVADVDGLGLEEETDEGGGLESKILAIKDFLEDPDQSEEELVSLLQNLADMDITYKALQETDIGRHVNGLRKHPSGDVRQLVKLLVRKWKEIVDGWVRLHNSGGDGGNSILTDGDSPEKTQGKSYQNARVSDFKYTPSPPQRHSGLSSERSRNNNGFESTLERHRASPAPTYHTKQNNGNNYSTTSSSAPARAMREQKDNHLDEKLDSARKRLQENYQEAQNAKKQRTMQVLDIHDIPKPKNKNTFIRKPGGGGLPGRHR

SEQ ID NO: 5075 - DNA, 1469 bp, Triticum aestivum
  misc_feature (1)..(1469): Ceres cDNA ID no. 22005551
  misc_feature (1)..(1469): Ceres CLONE  ID no. 575760
  misc_feature (1)..(1469): Also known as  Ceres CDNA ID no. 24409295
aaccacacacacttcttcaacctctcggcgctccagtcctttccgcctcactcccctcgcgcttcctcctccgcctcgtcgacccggtcccactcgcggcatcctccgccgccgcgccggcgcagcgatggcagcccgcgccccttacttcgcccccgaggaaggcgcgcggggcatccgcccaggggagtcacctgccgcggcgctccgccggatcctggcgacgccaggcgctcaccaggcgccctgctgcttcgacgcgctcggcgcccgcctcgtcgagcgcgcggggttcccgatctgcttcatgggcggtttctgtgtttctgccgcacgacttggattgccagatgttggattaatctcctatggagaaatggttgatcaagggcgtctaatcactgaagcagtttcagtccccgtgattggtgatggagacaatggttacggaaattctatgaacatcaagagaactgtaaaaggatatattaatgctgggttagctggaatcatgcttgaagatcaggtggcaccaaaagcatgtggacacactgaaggaaggaaagtcatctcgagggaggaagcggtcatgcacataaaagctgctatagacgctagaaaggagagtgcctctgacattgttattgtggcgaggacagattcccgtcaagctgtttctcttgatgaagcattatggagagttcaggcctttgctgatgctggagcagatgttctatttattgatgcccttgcttcaatagaagagatgaaggcattctgtgcggttgcacctggagtaccaaagatggcaaacatgttagaaggtggtggtaaaactcccatattgacccctgctgaactcaaggagattggttttagccttgtagtctatccgttgtccctaattggggtggcaatgcgtgcaatggaggatgctctactcgccataaaaggtggtggcgtacccccacctgccagcctgccatcttttcaggagatcaaggatactctagggttcaaccgctattaccaggaagataaacagtacactgtcccgcaagccgagccatcaatgccaactggtaacccgtagaaaggagcgaccctgttcaattctcaggagctatatggaaatgggatccaggtgtccactgagcgatcagtatccatttgctttcgagaatttgagatttgtgcctccgggcaatgaggcagagcaatcgcgtttatcctgaggcagacgattttagcaagttgtaaatgaggcggtgtgacgaaatgtttgtaaacgatgctgcttttggtgtcagcaaacctggattcttggtgtcactttcaataaaataaaccaactttgaggtagttgagaaatgtttctcaccagtgtttgtactttgtagtaagttgaagtaaaatagtaagaattgtcggcatgacagatttctttggcaccaaaaaaaaaaaaaaaa

SEQ ID NO: 5076 - protein, 321 aa, Triticum aestivum
  misc_feature: PFam Name: ICL; PFam Description: Isocitrate lyase family
  misc_feature: GI Number: 3763927; NR Description: putative carboxyphosphonoenolpyruvate mutase [Arabidopsis thaliana] >gi|25408843|pir||A84863 probable carboxyphosphonoenolpyruvate
  misc_feature: GI Number: 48891986; NR Description: COG2513: PEP phosphonomutase and related enzymes [Trichodesmium erythraeum
  misc_feature: GI Number: 21537183; NR Description: carboxyphosphonoenolpyruvate mutase, putative [Arabidopsis thaliana] gi|18411340|ref|NP_565148.1| mutase family protein
  misc_feature: GI Number: 21386949; NR Description: putative carboxyphosphonoenolpyruvate mutase [Arabidopsis thaliana] gi|18252195|gb|AAL61930.1| putative carboxyphosphonoenolpyruvate
  misc_feature: GI Number: 51317959; NR Description: carboxyphosphonoenolpyruvate phosphonomutase [Streptomyces
MAARAPYFAPEEGARGIRPGESPAAALRRILATPGAHQAPCCFDALGARLVERAGFPICFMGGFCVSAARLGLPDVGLISYGEMVDQGRLITEAVSVPVIGDGDNGYGNSMNIKRTVKGYINAGLAGIMLEDQVAPKACGHTEGRKVISREEAVMHIKAAIDARKESASDIVIVARTDSRQAVSLDEALWRVQAFADAGADVLFIDALASIEEMKAFCAVAPGVPKMANMLEGGGKTPILTPAELKEIGFSLVVYPLSLIGVAMRAMEDALLAIKGGGVPPPASLPSFQEIKDTLGFNRYYQEDKQYTVPQAEPSMPTGNP

SEQ ID NO: 5077 - DNA, 1533 bp, Triticum aestivum
  misc_feature (1)..(1533): Ceres cDNA ID no. 22005552
  misc_feature (1)..(1533): Ceres CLONE  ID no. 575942
  misc_feature (1)..(1533): Also known as  Ceres CDNA ID no. 23723748
ctccaggtcagatctcgccgcccaccacggccgcgcacaatgggctctgcacattcgtcccactcctccatctctaccgcggccgacgaaggcgacgatgatccatcgactgcctcagcctcggagccctcggcccggccccctcccgcccaagcgccggctccaccggcctctgcgtccaaggtgctggagcaggagcccgaggtgctaccctgccgagccgccgactcgccgctctcgccgcaaccatccgtaacgggcaccccacgcctcctcggccccaacatcaaggtctgggacccctgccacgtgctccttcccccaccgtcgctgcaccagcacctcccgcagcaggggaggacggaggcgctgctggaggtggtaatagttagccacggggaatgtgcgttcgcgatgcgacccgacctggttggtgggcgatggccggcagtggccctcacggcgcgcggggagcgacaggcgcgcgctctgtcagtgttcctgcgctcccgtggttcgcagctggccgctgcgtggacgtcgcccctcgaccgttcccgcgctactgctgaacttgtctgccgggaacttgattttccagaggagcagatccaagtatctgatgctttgactgagatgagtcatggtcagtgggagggttgcccaaaatcagaaatttataccccagaaatggttaatctgatggacagcacccagcctgatttctcagcaccttcaggagagtcactcaggcaggtgcagttcaggatgatggagttcctgaaccgaacaatcataaggttaccagaaaaggtggcaatgggggatacactatcacaacaaaatgacgcaaagggtttatctcggcagagctccaccaattctgtccaagatggcccatcttgggatttgctttacaggctcaatcggcatagcctccaaaggaagaaatctggtaaaagccgtctccagtttgtcacttcggttgacaatgataccgaggatgagttctccctgaaagacataaaccaaaggcatcgccttcacgaaacaagtctggggagctctacaacctccattgcaattttcagccatgcaatccctattcgatgtctccttgcgggcttgttggactgcaaccctgtgatgtctcagaggatatgtatagacgattcatctgtcactgttcttgaacattcgcttagaaccgggtggcgaataaagaggctaaatgatactgggcatctcaggcttctctagctgcaagctgttgcgctgcagctggaatctaactgatgtgtgtttatgtgtcgtaaagaaaccatcagatcatattatgcaaatcagaagctatggttgtcggttcatgttcacctatgcctcaatggggaatgcaagtcctccgattgttgttattttgcatttattaccatgcctaaattccgggaagaactgccctgtgattgtgttaccctgtgattgttaatcaatattttatcaagtgtaatttccaactcaaaaaaaaaaaaaaaa

SEQ ID NO: 5078 - protein, 406 aa, Triticum aestivum
  misc_feature: PFam Name: PGAM; PFam Description: Phosphoglycerate mutase family
  misc_feature: GI Number: 17902574; NR Description: putative
  misc_feature: GI Number: 17902578; NR Description: putative
  misc_feature: GI Number: 21386798; NR Description: X4 protein [Silene dioica]
  misc_feature: GI Number: 21386782; NR Description: X4 protein [Silene latifolia]
  misc_feature: GI Number: 19743676; NR Description: SlX4-like protein
  misc_feature: Utility: Useful for making plants tolerant to low nitrogen
MGSAHSSHSSISTAADEGDDDPSTASASEPSARPPPAQAPAPPASASKVLEQEPEVLPCRAADSPLSPQPSVTGTPRLLGPNIKVWDPCHVLLPPPSLHQHLPQQGRTEALLEVVIVSHGECAFAMRPDLVGGRWPAVALTARGERQARALSVFLRSRGSQLAAAWTSPLDRSRATAELVCRELDFPEEQIQVSDALTEMSHGQWEGCPKSEIYTPEMVNLMDSTQPDFSAPSGESLRQVQFRMMEFLNRTIIRLPEKVAMGDTLSQQNDAKGLSRQSSTNSVQDGPSWDLLYRLNRHSLQRKKSGKSRLQFVTSVDNDTEDEFSLKDINQRHRLHETSLGSSTTSIAIFSHAIPIRCLLAGLLDCNPVMSQRICIDDSSVTVLEHSLRTGWRIKRLNDTGHLRLL

SEQ ID NO: 5079 - DNA, 1599 bp, Triticum aestivum
  misc_feature (1)..(1599): Ceres cDNA ID no. 22005553
  misc_feature (1)..(1599): Ceres CLONE  ID no. 576276
  misc_feature (1)..(1599): Also known as  Ceres CDNA ID no. 25088255
ttttttgcatgcaatatctgcggtaaacaggcgcggcagcttcccaagaatcaattcaaaccagacggcggcgccccgacgaggagaggagacggtggtgctgcggccgcgccaccaggcagctgccacttgtaccctgctagtctctccacctagatgccgctgcggcggctgcaagcccctcgccacgcgcgcgccgcggccacgctctcctcggcggccgcccaccacctgttcgacggaatccctcgcccaacccgcggcagcacgcctctctgtctctcctccccccgcgcgggccaccccgtccccgccctcgtctcgtcccccaccgcgttctcggccgccgtcgcgtcgtccgaccgggccaccctcccggcgctccacgcgctcgccgtcgcctcgggcctcgacgccttcgccttcgtgtccaactccctcgccgcccgctacgccaagaccggctccttcccctcggcggccagggtgttcggcaccgcccgggcgagggacgtcagctcctacaacaccatgctctccgcgttcccggacccggccgaggcgctcgcgttcgcgtcctggatgctccggtcgggcgacgtgcggcccgacgccgtcacgttcaccgtcgcgctgtcgctcgccgccggccgcggggagggcggcctcggggtagttcggcagctccacgcgctggcgtcgcgggccgggctcgccgccgacgtgttcgtcggcaacgcgctcgtcacggcctactcacggggagggctcctcggcgcggccaggagggcgttcgaggagatgccggcgcgggacctggtctcctggaacgcgatgatctgcgggctcgcgcaggacggcggctgcccggcggaggtggtccggctgttcctccggatgctcaaagacgacgccgtccggcccgaccggatatccgcgtgcagcgtgatcccggcgtgcggcggcgaggggaagctcgagcttggccggcaagtgcacggcctcggggtgaagctgggcgtcgacgggcacgtcaccatcggcaacgtgctcgtcgccatgtactacaagtgcggcgctccagcctgcggccggaagtacctgcagtccatgggcgagcgcgacgtcatctcgtggaccacaatcatttcaatggacgaggacgaggacgccgtcgcactgttcaatggcatgcggcgagacggcgtgtcgccgaacgaggtcaccttcgtggcgctcatgtcggcgctgccggcagggtgcccggcgagggacgggcagatgatccacgcggtgtgcctgaagaccggcgcctccgacaaggccgccgcgtccaacagcctcatcaccatgtacgcgaagctgcggcgcatggacgacgcgcggacggtgttcgacctcatgcctcgccgggagaccatcgcctggaatgccctgatctcgggctacgcgcagaacgagcggtgcagcgacgctctggaggccttctcgtggatggtcaagtgttttaacatatgatgtacacacgattattttactatagggttttcatgtctcgatttatatgatgcgtcattttagcgaaaaaaaaaaaaaaaa

SEQ ID NO: 5080 - protein, 453 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: LMBR1; PFam Description: LMBR1-like membrane protein
  misc_feature: PFam Name: GATase_2; PFam Description: Glutamine
  misc_feature: GI Number: 50939845; NR Description: selenium-binding protein-like protein [Oryza sativa (japonica cultivar-group)] >gi|22831115|dbj|BAC15976.1| selenium-binding protein-like protein [Oryza sativa (japonica cultivar-group)] [Oryza sativa
  misc_feature: GI Number: 30102674; NR Description: At4g32430 [Arabidopsis thaliana] >gi|30689384|ref|NP_194969.2| pentatricopeptide (PPR)
  misc_feature: GI Number: 54695180; NR Description: PPR986-12
  misc_feature: GI Number: 15220337; NR Description: pentatricopeptide (PPR)
  misc_feature: GI Number: 34914806; NR Description: B1045D11.13 [Oryza sativa (japonica cultivar-group)] >gi|14587213|dbj|BAB61147.1|
MPLRRLQAPRHARAAATLSSAAAHHLFDGIPRPTRGSTPLCLSSPRAGHPVPALVSSPTAFSAAVASSDRATLPALHALAVASGLDAFAFVSNSLAARYAKTGSFPSAARVFGTARARDVSSYNTMLSAFPDPAEALAFASWMLRSGDVRPDAVTFTVALSLAAGRGEGGLGVVRQLHALASRAGLAADVFVGNALVTAYSRGGLLGAARRAFEEMPARDLVSWNAMICGLAQDGGCPAEVVRLFLRMLKDDAVRPDRISACSVIPACGGEGKLELGRQVHGLGVKLGVDGHVTIGNVLVAMYYKCGAPACGRKYLQSMGERDVISWTTIISMDEDEDAVALFNGMRRDGVSPNEVTFVALMSALPAGCPARDGQMIHAVCLKTGASDKAAASNSLITMYAKLRRMDDARTVFDLMPRRETIAWNALISGYAQNERCSDALEAFSWMVKCFNI

SEQ ID NO: 5081 - DNA, 1483 bp, Triticum aestivum
  misc_feature (1)..(1483): Ceres cDNA ID no. 22005554
  misc_feature (1)..(1483): Ceres CLONE  ID no. 584895
  misc_feature (1)..(1483): Also known as  Ceres CDNA ID no. 24408818
atcacggcagtccttcacgccacgctcatccgcaccgccgcccccgaccgtgcgtcccccatccgaaccctagcagccccgttgaccagcgcggcgaccgccatggacggcctcgtcgccttctcccgccgccgccgccgctggctcctcctcgcggcgctggggacggcgtcggcctacggcgcgtacaagatctaccacctcccggccgtcgccgcccgccgccgccgcctcgtccgcctcgccgccgccctcgcggccttcctcgacgcggccgcgtcctccgccgacgccgccgccctggtctcctccgacctcgccgacttcgtccgctccgactccgacgagctcccccgcagcgtcgcgcagctcgccaagctcgccgcctcccccgaggtctccgccaccgtctccgcgctctcccaggccatcgcggccggggtgctccgcggcgtcggctccgcccccgggcccggctccggcgacaaggtggccctcacggaccgcctcgtcgacaagctcttctccgactccggggagcgcctcgcgtccgctgtcgccgggagcttcgcacgccacctcgtaatggccttctactccgcgccgtctcctcccgggcagacctcctcatcgcccgattgggtcaacgtggttgcaacgggaaaggggcacaaggcgattagcagctgggttgaggtcctcgtcggcaccgccgtgggggtgttcattgacaagaccatacacatcaatacctacgagcagctcttcgaagggctcaccaatccaacccacgacgccaaggtcaaggaattgcttgtttcagtatgcaatggggcagtggagactttggtgaagacctctcaccaagttatctccaaggccaatagtaaattggataacaatggcgatggcaagagcaatagcagtggcagtggcgctagcagagctgcggaagggtgggtggagacagtctctagcacattggcagtgccaagcaacaggaattttgtgcttgatgttacagggagggtgacatttgagactgtgaggtcatttcttgagtttgtgctgtggaagctgcacgatggggcgaggaagagtggggacaccgtgtgcgacagcggactgcgcgccgtgaggtatatgagtgataagtctatggttgtcgccacgatctgcataacattgtgcctgcatgtgttgaatggaactcgattcctggttaccgcttgagcatgcagtcaacagggtgggggcttttcgcttgtattatttgcacattgtttatgtacaaaccataggtaaaattgtactgaaaaactgtaaattcaactaaaaaaagagctgaaagggggtacttggctgcaaggctttattatggcttatgtttggggttgttattcatggctgtaatgggagtggttgatttgttgtgcccttgagaaagtgtgtttgcggcattatttggaaaaaaaaaaaaaaa

SEQ ID NO: 5082 - protein, 1483 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: LMBR1; PFam Description: LMBR1-like membrane protein
  misc_feature: PFam Name: Extensin_2; PFam Description: Extensin-like region
  misc_feature: PFam Name: GATase_2; PFam Description: Glutamine
  misc_feature: GI Number: 21554418; NR Description: unknown [Arabidopsis thaliana]
  misc_feature: GI Number: 21553547; NR Description: unknown [Arabidopsis thaliana]
  misc_feature: GI Number: 6523547; NR Description: hydroxyproline-rich
  misc_feature: GI Number: 60678627; NR Description: plus agglutinin
  misc_feature: GI Number: 27375632; NR Description: blr0521 [Bradyrhizobium japonicum USDA 110] >gi|27348769|dbj|BAC45786.1| blr0521
ATCACGGCAGTCCTTCACGCCACGCTCATCCGCACCGCCGCCCCCGACCGTGCGTCCCCCATCCGAACCCTAGCAGCCCCGTTGACCAGCGCGGCGACCGCCATGGACGGCCTCGTCGCCTTCTCCCGCCGCCGCCGCCGCTGGCTCCTCCTCGCGGCGCTGGGGACGGCGTCGGCCTACGGCGCGTACAAGATCTACCACCTCCCGGCCGTCGCCGCCCGCCGCCGCCGCCTCGTCCGCCTCGCCGCCGCCCTCGCGGCCTTCCTCGACGCGGCCGCGTCCTCCGCCGACGCCGCCGCCCTGGTCTCCTCCGACCTCGCCGACTTCGTCCGCTCCGACTCCGACGAGCTCCCCCGCAGCGTCGCGCAGCTCGCCAAGCTCGCCGCCTCCCCCGAGGTCTCCGCCACCGTCTCCGCGCTCTCCCAGGCCATCGCGGCCGGGGTGCTCCGCGGCGTCGGCTCCGCCCCCGGGCCCGGCTCCGGCGACAAGGTGGCCCTCACGGACCGCCTCGTCGACAAGCTCTTCTCCGACTCCGGGGAGCGCCTCGCGTCCGCTGTCGCCGGGAGCTTCGCACGCCACCTCGTAATGGCCTTCTACTCCGCGCCGTCTCCTCCCGGGCAGACCTCCTCATCGCCCGATTGGGTCAACGTGGTTGCAACGGGAAAGGGGCACAAGGCGATTAGCAGCTGGGTTGAGGTCCTCGTCGGCACCGCCGTGGGGGTGTTCATTGACAAGACCATACACATCAATACCTACGAGCAGCTCTTCGAAGGGCTCACCAATCCAACCCACGACGCCAAGGTCAAGGAATTGCTTGTTTCAGTATGCAATGGGGCAGTGGAGACTTTGGTGAAGACCTCTCACCAAGTTATCTCCAAGGCCAATAGTAAATTGGATAACAATGGCGATGGCAAGAGCAATAGCAGTGGCAGTGGCGCTAGCAGAGCTGCGGAAGGGTGGGTGGAGACAGTCTCTAGCACATTGGCAGTGCCAAGCAACAGGAATTTTGTGCTTGATGTTACAGGGAGGGTGACATTTGAGACTGTGAGGTCATTTCTTGAGTTTGTGCTGTGGAAGCTGCACGATGGGGCGAGGAAGAGTGGGGACACCGTGTGCGACAGCGGACTGCGCGCCGTGAGGTATATGAGTGATAAGTCTATGGTTGTCGCCACGATCTGCATAACATTGTGCCTGCATGTGTTGAATGGAACTCGATTCCTGGTTACCGCTTGAGCATGCAGTCAACAGGGTGGGGGCTTTTCGCTTGTATTATTTGCACATTGTTTATGTACAAACCATAGGTAAAATTGTACTGAAAAACTGTAAATTCAACTAAAAAAAGAGCTGAAAGGGGGTACTTGGCTGCAAGGCTTTATTATGGCTTATGTTTGGGGTTGTTATTCATGGCTGTAATGGGAGTGGTTGATTTGTTGTGCCCTTGAGAAAGTGTGTTTGCGGCATTATTTGGAAAAAAAAAAAAAAA

SEQ ID NO: 5083 - DNA, 1058 bp, Triticum aestivum
  misc_feature (1)..(1058): Ceres cDNA ID no. 22005555
  misc_feature (1)..(1058): Ceres CLONE  ID no. 584927
  misc_feature (1)..(1058): Also known as  Ceres CDNA ID no. 23476793
cttatctcctcgtctcgcaaaagcagagacagaagagagatcgattccgactaaaacctctcgccgccgacgaccaagctcggagacctattgacctagttcctgatgtcggacgccgatgattaccgttgcttcgttgggagtctgtcatggaacacaactgatgtggatctgaaggatgcgtttgggaaatttggtcgagttactgagaccaaggtggttcttgacaagttctctggccggtcacgtggctttggatttgtgacttttgatgacaagaaggccatggaagaagctgttgaggctatgaatggaattgatttggatggaaggaatattactgttgaaagagcacaacctcaaggttcaggcagggaccgtgatggagatcgagactatcgtggtggtggtgaccgctatggtggtggccgtgattttggtggcggtcgtggtggtggtcgtggtggcggcggtgattgctacaaatgtggcaagcctggtcattttgcaagggagtgcccttctggtgatggtggggacaggtatggtagcagggatgacaggtatagtagcagggatgacaggtatagtagtagggatgacaggtatggtggcagggatggtggaagggatgacaagtatggtggtagcaacggcagcagtcgctatgggcctgaccgtggtggtgatcgctattctggaagtcgtgatggaggaagccgcagcagtggtggcggtgatcgatacagccgtgacaggtctggaccgtatgatcgtcgcagccgagatgaatactgatcttgatggtggagattctgtctcaggtatgaaaggtattggataatactagtggtatgtttgctttatcacataaggcagcaaatggtttgctgttgtactctttatgagaagtttaatgcttttgttatccatgctgactagtgcttggtttaccaatgttcctacctggatttggcttgtaaccggttccttgggagcttcagtggattgcgttattttgtctgagtaatatttgggatccaaaaaaaaaaaaaaaa

SEQ ID NO: 5084 - protein, 1058 aa, Triticum aestivum
  misc_feature: PFam Name: RRM_1; PFam Description: RNA recognition motif.
  misc_feature: PFam Name: GRP; PFam Description: Glycine rich protein family
  misc_feature: GI Number: 12659074; NR Description: RNA-binding protein
  misc_feature: GI Number: 50919955; NR Description: putative RNA binding protein [Oryza sativa (japonica cultivar-group)] >gi|40714682|gb|AAR88588.1| putative RNA binding protein [Oryza
  misc_feature: GI Number: 2129944; NR Description: RNA-binding protein RZ-1 - wood tobacco >gi|1395193|dbj|BAA12064.1| RNA-binding protein RZ-1 [Nicotiana sylvestris] >gi|1435062|dbj|BAA06012.1| RNA binding
  misc_feature: GI Number: 19699180; NR Description: AT3g26420/F20C19_14 [Arabidopsis thaliana] >gi|15982739|gb|AAL09710.1|
  misc_feature: GI Number: 50934801; NR Description: glycine-rich RNA-binding protein-like [Oryza sativa (japonica cultivar-group)] >gi|33146923|dbj|BAC79944.1| glycine-rich RNA-binding protein-like [Oryza sativa (japonica cultivar-group)] [Oryza
CTTATCTCCTCGTCTCGCAAAAGCAGAGACAGAAGAGAGATCGATTCCGACTAAAACCTCTCGCCGCCGACGACCAAGCTCGGAGACCTATTGACCTAGTTCCTGATGTCGGACGCCGATGATTACCGTTGCTTCGTTGGGAGTCTGTCATGGAACACAACTGATGTGGATCTGAAGGATGCGTTTGGGAAATTTGGTCGAGTTACTGAGACCAAGGTGGTTCTTGACAAGTTCTCTGGCCGGTCACGTGGCTTTGGATTTGTGACTTTTGATGACAAGAAGGCCATGGAAGAAGCTGTTGAGGCTATGAATGGAATTGATTTGGATGGAAGGAATATTACTGTTGAAAGAGCACAACCTCAAGGTTCAGGCAGGGACCGTGATGGAGATCGAGACTATCGTGGTGGTGGTGACCGCTATGGTGGTGGCCGTGATTTTGGTGGCGGTCGTGGTGGTGGTCGTGGTGGCGGCGGTGATTGCTACAAATGTGGCAAGCCTGGTCATTTTGCAAGGGAGTGCCCTTCTGGTGATGGTGGGGACAGGTATGGTAGCAGGGATGACAGGTATAGTAGCAGGGATGACAGGTATAGTAGTAGGGATGACAGGTATGGTGGCAGGGATGGTGGAAGGGATGACAAGTATGGTGGTAGCAACGGCAGCAGTCGCTATGGGCCTGACCGTGGTGGTGATCGCTATTCTGGAAGTCGTGATGGAGGAAGCCGCAGCAGTGGTGGCGGTGATCGATACAGCCGTGACAGGTCTGGACCGTATGATCGTCGCAGCCGAGATGAATACTGATCTTGATGGTGGAGATTCTGTCTCAGGTATGAAAGGTATTGGATAATACTAGTGGTATGTTTGCTTTATCACATAAGGCAGCAAATGGTTTGCTGTTGTACTCTTTATGAGAAGTTTAATGCTTTTGTTATCCATGCTGACTAGTGCTTGGTTTACCAATGTTCCTACCTGGATTTGGCTTGTAACCGGTTCCTTGGGAGCTTCAGTGGATTGCGTTATTTTGTCTGAGTAATATTTGGGATCCAAAAAAAAAAAAAAAA

SEQ ID NO: 5085 - DNA, 563 bp, Glycine max
  misc_feature (1)..(563): Ceres cDNA ID no. 22005556
  misc_feature (1)..(563): Ceres CLONE  ID no. 597981
  misc_feature (1)..(563): Also known as  Ceres CDNA ID no. 24401983
acactgattgagagaaaaataatggaggcttacactaaggttgtttgcattcttggacttttaatttttgtaagcatttcagatattcatagagtggagggtgcaggggaatgtgggaggtctactactccagataatgaagcaataaagcttattccttgtgtctctgccgcaaaagatgaaaatgttaaagttactaagaattgctgtgctcagatcgagaaacttggcaagaaccctagttgtctatgtgctgttatgctctccaacacagcaaaaatgtctggagccgatcctaaggttgccataaccatcccaaaacgctgcaaccttgctaatcgccctgttggttacaagtgtggaccttacactcttccttaagatagtactgaggacaaggagggatttgggcgtgaaggcacaaaagctgttggctacaactgtgactacaaaactatgttttattgtccttgaaacaatttgatcaataatggcaagtagctatatggtgttcttcctgaataaaactagaaattttaatgtttaaaaaaaaaaaaaaaaaa

SEQ ID NO: 5086 - protein, 119 aa, Glycine max
  misc_feature: PFam Name: Tryp_alpha_amyl; PFam Description: Protease
  misc_feature: GI Number: 21593924; NR Description: unknown [Arabidopsis thaliana]
  misc_feature: GI Number: 21592534; NR Description: unknown [Arabidopsis thaliana] >gi|18415051|ref|NP_568160.1| protease inhibitor/seed storage/lipid transfer protein (LTP) family protein [Arabidopsis
MEAYTKVVCILGLLIFVSISDIHRVEGAGECGRSTTPDNEAIKLIPCVSAAKDENVKVTKNCCAQIEKLGKNPSCLCAVMLSNTAKMSGADPKVAITIPKRCNLANRPVGYKCGPYTLP

SEQ ID NO: 5087 - DNA, 1592 bp, Glycine max
  misc_feature (1)..(1592): Ceres cDNA ID no. 22005557
  misc_feature (1)..(1592): Ceres CLONE  ID no. 605337
  misc_feature (1)..(1592): Also known as  Ceres CDNA ID no. 24402922
aagttcaaagttcgaagccatgcgaatgaagccaatccagctcccggagccgccaagccccacggcggcgcgtggcactccggacatcttcgaatccggcgtccacaccctcgtccgccgcgccgtcgtcatcggcaacggcttcccctcctccgagaatcacagcatcggtttgctccgcgcccttggcctctcccacaaccacctcctctaccgcgttacgaggccgagaggtggaatcaacgattggctccattggcttcccctctctgtccatcgaaaatttcattacctaatttccatgttccgcgccttctcctccaaatctcactacctgcccctcacttcccaccctaacggcttgtcctctattctcgaagctgatgccaatcacatagtcaatttggctcgcgaaacttgtgaaaaggagggaccgttattggtggttgcatctggaagagacaccatttctgttgcgagttccataaaacgtttagctcctgaccttgtttttgttgttcagatacaacatccaaggtctcatttgaataggtttgacatggtaattacacctcatcatgattattatcctttgactccagaaggacagaagcaggttcctaagtttcttagaaggtggataactccacgcgaacctccagatagtcatgtggttctgacattgggagccttacatcgaatagattttgcttcacttcgcagtgctgccattacatggcaagatgtgtttgcaaatgttccaaggccattgctcgtggtcaacattggaggaccaacaagaaactgtcggtatggtgtcgaccttgcaaagcagttagcaacatgtttgctcagtgttcttggtagttgtgggagtgtaagaatatccttttcagataggactccacaaaagttatcgaatattatagtcaaagaacttggaaataatccaaaagtttatatttgggatgggcaagaaccaaacccacaaatggggcatctagcttgggccgatgcatttgttgtcacagcagattcagttagcatgataagtgaagcttgcagcactgggaagcctgtgtatattatgggagctgagcgttgcagatggaagttcacagaattccacaaatcattgagagaacgaggagttgttcggccttttacagggtctgaggatatatcggaaaattggagttatccaccccttgatgacacttctgatgcagctaaacgggttcatgaagcgcttgctgcccgagggtggaaactgaagatatagaacacaattattagttcacatgatactcaatttttgttatatttatcgttaaggtcgtaaccatttgttgtttggaagatagtgtccaaaatttcatgtttctttgatagcacgaatagaaaataccgtttgggtgttcgtcattctttccaccatagcaattttcaaggatgtaatgtagtataaggttaactgtgcgattgcagcttgtaaactgggaggaaattttttacttttttgtgccgattgacacattttaataaatgaggtgaataaaaaatttgtttgtgctgtaaaaaaaaaaaaaaaa

SEQ ID NO: 5088 - protein, 1592 aa, Glycine max
  misc_feature: GI Number: 48764402; NR Description: COG3660: Predicted
  misc_feature: GI Number: 46201994; NR Description: COG3660: Predicted nucleoside-diphosphate-sugar epimerase [Magnetospirillum
  misc_feature: GI Number: 52698473; NR Description: COG3660: Predicted nucleoside-diphosphate-sugar epimerase [Rickettsia akari str.
  misc_feature: GI Number: 53611705; NR Description: COG3660: Predicted
  misc_feature: GI Number: 52857308; NR Description: COG3660: Predicted
AAGTTCAAAGTTCGAAGCCATGCGAATGAAGCCAATCCAGCTCCCGGAGCCGCCAAGCCCCACGGCGGCGCGTGGCACTCCGGACATCTTCGAATCCGGCGTCCACACCCTCGTCCGCCGCGCCGTCGTCATCGGCAACGGCTTCCCCTCCTCCGAGAATCACAGCATCGGTTTGCTCCGCGCCCTTGGCCTCTCCCACAACCACCTCCTCTACCGCGTTACGAGGCCGAGAGGTGGAATCAACGATTGGCTCCATTGGCTTCCCCTCTCTGTCCATCGAAAATTTCATTACCTAATTTCCATGTTCCGCGCCTTCTCCTCCAAATCTCACTACCTGCCCCTCACTTCCCACCCTAACGGCTTGTCCTCTATTCTCGAAGCTGATGCCAATCACATAGTCAATTTGGCTCGCGAAACTTGTGAAAAGGAGGGACCGTTATTGGTGGTTGCATCTGGAAGAGACACCATTTCTGTTGCGAGTTCCATAAAACGTTTAGCTCCTGACCTTGTTTTTGTTGTTCAGATACAACATCCAAGGTCTCATTTGAATAGGTTTGACATGGTAATTACACCTCATCATGATTATTATCCTTTGACTCCAGAAGGACAGAAGCAGGTTCCTAAGTTTCTTAGAAGGTGGATAACTCCACGCGAACCTCCAGATAGTCATGTGGTTCTGACATTGGGAGCCTTACATCGAATAGATTTTGCTTCACTTCGCAGTGCTGCCATTACATGGCAAGATGTGTTTGCAAATGTTCCAAGGCCATTGCTCGTGGTCAACATTGGAGGACCAACAAGAAACTGTCGGTATGGTGTCGACCTTGCAAAGCAGTTAGCAACATGTTTGCTCAGTGTTCTTGGTAGTTGTGGGAGTGTAAGAATATCCTTTTCAGATAGGACTCCACAAAAGTTATCGAATATTATAGTCAAAGAACTTGGAAATAATCCAAAAGTTTATATTTGGGATGGGCAAGAACCAAACCCACAAATGGGGCATCTAGCTTGGGCCGATGCATTTGTTGTCACAGCAGATTCAGTTAGCATGATAAGTGAAGCTTGCAGCACTGGGAAGCCTGTGTATATTATGGGAGCTGAGCGTTGCAGATGGAAGTTCACAGAATTCCACAAATCATTGAGAGAACGAGGAGTTGTTCGGCCTTTTACAGGGTCTGAGGATATATCGGAAAATTGGAGTTATCCACCCCTTGATGACACTTCTGATGCAGCTAAACGGGTTCATGAAGCGCTTGCTGCCCGAGGGTGGAAACTGAAGATATAGAACACAATTATTAGTTCACATGATACTCAATTTTTGTTATATTTATCGTTAAGGTCGTAACCATTTGTTGTTTGGAAGATAGTGTCCAAAATTTCATGTTTCTTTGATAGCACGAATAGAAAATACCGTTTGGGTGTTCGTCATTCTTTCCACCATAGCAATTTTCAAGGATGTAATGTAGTATAAGGTTAACTGTGCGATTGCAGCTTGTAAACTGGGAGGAAATTTTTTACTTTTTTGTGCCGATTGACACATTTTAATAAATGAGGTGAATAAAAAATTTGTTTGTGCTGTAAAAAAAAAAAAAAAA

SEQ ID NO: 5089 - DNA, 913 bp, Glycine max
  misc_feature (1)..(913): Ceres cDNA ID no. 22005558
  misc_feature (1)..(913): Ceres CLONE  ID no. 614690
  misc_feature (1)..(913): Also known as  Ceres CDNA ID no. 24398689
aagaacaaaattaaatttactattttgtgtgtgacactgtgtcttatttatgctctttctgtattttctttctacatctatattctaaaccttccttttcctttctgtctgcacctgcgttttcatttattgatgtccttcttttgttttatttgccaagatgattttctgattggtttttgatgttacaaggaaatctgggcatgttccacgagcctatcttacaggactaaagagtgagtgatggaggaattggcaggggcgtttggcaccagcgccagcttggctcttcgtttgggtcaaaccgttttctcttcttcttcccttctcttcatgtgtttggacgttggtttctactcttacactgctttctgctatttggtaacagtcatgggtttggtaattccatggaacataacattgttggtggtggatgcttactctgtcttcatacagtatttaccgattcaacgaaggctcataatgataatcttttttggagacatgattttgtcatatctgtcactagctgcagcatgttctacagccagtatcgcagatcttctgctagaagctggaggatcacattgcccaccaaagttatgtggtagatatcaattgtctgctgctatggccttcttgtcttggtttctttcatttgtttcctttcttttcaatttttggctattctcttccctgtaaaatattttgctccctgttgatgtatagataaatgaaaagggtgcaaatgacaaagtcatttgctcttgggcatgtatattttttgttctcttgaaaataaaattttcatgactactgtgattagtcaatactcaacaatgtaatagttgctctttcaatgcaagggaaatatggaaggtttgtttcttggctctcaaaaaaaaaaaaaaaa

SEQ ID NO: 5090 - protein, 152 aa, Glycine max
  misc_feature: GI Number: 22330130; NR Description: integral membrane
  misc_feature: GI Number: 56784709; NR Description: integral membrane protein-like [Oryza sativa (japonica cultivar-group)] gi|56784036|dbj|BAD82664.1| integral membrane protein-like [Oryza
  misc_feature: GI Number: 38604002; NR Description: At2g37200 [Arabidopsis thaliana] >gi|38454082|gb|AAR20735.1| At2g37200 [Arabidopsis thaliana] >gi|30687069|ref|NP_181257.2| integral membrane protein,
  misc_feature: GI Number: 50898970; NR Description: integral membrane protein-like [Oryza sativa (japonica cultivar-group)] >gi|47497809|dbj|BAD19907.1| integral membrane protein-like [Oryza
MEELAGAFGTSASLALRLGQTVFSSSSLLFMCLDVGFYSYTAFCYLVTVMGLVIPWNITLLVVDAYSVFIQYLPIQRRLIMIIFFGDMILSYLSLAAACSTASIADLLLEAGGSHCPPKLCGRYQLSAAMAFLSWFLSFVSFLFNFWLFSSL

SEQ ID NO: 5091 - DNA, 1077 bp, Triticum aestivum
  misc_feature (1)..(1077): Ceres cDNA ID no. 22005559
  misc_feature (1)..(1077): Ceres CLONE  ID no. 615686
  misc_feature (1)..(1077): Also known as  Ceres CDNA ID no. 24409015
agtcgaagccccgacgctccacagcggccagcgcctccagtcgctcccagttcccctccgcccgcggcgcgccgctcccggcagcctcggtcgctgccgccgcctccgcctccgcctaccgccggccgacgacgccctccgacccctcccgccgccgccgccgtcttcaaccgcttatttgcccacgctcctaccaaatcgcctctcagttgagcaatccaagtgaagcagatggctacatcagaaccggtacaggaaagctgggagctggaacccagtaggcctcgggtcctccttgctgcttcagggagtgtagctgctataaaattcgagagcctctgtcgtgtcttctccgagtgggcggaagtccgagctgtggcgaccaagtcatcattgcactttattgagagatcatctctgcctagcgacgtcattctttacactgatgatgatgagtggtctacctggacgaagataggagacgaggttctgcacatagagctgcggaagtgggcagacatcatggtgatcgcccccttatcagcaaacactctggccaagatcgctggtgggttatgcgacaacctcctgacatgcatagtgcgggcgtgggactacaagaagccgatcttcgccgctccagccatgaacaccttcatgtggaacaacccgttcacggcgcgccacatcgagacgatcaaccaactcgggatttccttggtcccacccaccacgaagaggctggcctgcggcgactacgggaacggcgcgatggctgagccttcacagatccatacgaccgtgaggctcgcgtgcaagtcacatacgttcggcacgggcaattcacccgcgatcccttccagcagccaccctgtctagccgatgcagtggtcgatatgttcacttcaggtgttcaagagcttagtgtttcgcgttttctgtgccggcccatgtctgggtgtaaggagtggagagtatcatcaggtgtttgtttgtcggtgatgtctgtgttaaccaacgtgtcgtacctatggaacatggatcagtatatttgttactgtaaaaaaaaaaaaaaaa

SEQ ID NO: 5092 - protein, 215 aa, Triticum aestivum
  misc_feature: PFam Name: Flavoprotein; PFam Description: Flavoprotein
  misc_feature: PFam Name: FH2; PFam Description: Formin Homology 2 Domain
  misc_feature: GI Number: 51090974; NR Description: putative HAL3B [Oryza sativa (japonica cultivar-group)] gi|51091832|dbj|BAD36646.1|
  misc_feature: GI Number: 52218792; NR Description: At3g18030 [Arabidopsis thaliana] >gi|11994209|dbj|BAB01331.1| HAL3A protein [Arabidopsis thaliana] >gi|48310154|gb|AAT41764.1| At3g18030 [Arabidopsis
  misc_feature: GI Number: 8778701; NR Description: T1N15.24 [Arabidopsis thaliana]
  misc_feature: GI Number: 28948674; NR Description: Chain A, Ppc Decarboxylase Mutant C175s Complexed With Pantothenoylaminoethenethiol >gi|28948673|pdb|1MVL|A Chain A, Ppc
  misc_feature: GI Number: 40556079; NR Description: CNPV141 HAL3-like domain protein [Canarypox virus] >gi|40233904|gb|AAR83487.1| CNPV141
MATSEPVQESWELEPSRPRVLLAASGSVAAIKFESLCRVFSEWAEVRAVATKSSLHFIERSSLPSDVILYTDDDEWSTWTKIGDEVLHIELRKWADIMVIAPLSANTLAKIAGGLCDNLLTCIVRAWDYKKPIFAAPAMNTFMWNNPFTARHIETINQLGISLVPPTTKRLACGDYGNGAMAEPSQIHTTVRLACKSHTFGTGNSPAIPSSSHPV

SEQ ID NO: 5093 - DNA, 1136 bp, Triticum aestivum
  misc_feature (1)..(1136): Ceres cDNA ID no. 22005562
  misc_feature (1)..(1136): Ceres CLONE  ID no. 618577
  misc_feature (1)..(1136): Also known as  Ceres CDNA ID no. 24409073
atactcttttgtagccatcctcccgtctatttgtgctctgctcacaagccaaggccaagcagcagcagacacgcgaaagcaaactcacaaggagcgaagaagaaacccagctaggagcgtctggtgcattggagcaggagaccaatggcgggcctcgggttcgaggagacggagctccggctcggcctgccaggcggcggcaacgaggccgaggaggcggccgccgcggtgaggagctccggcaagaggggctacgccgagaccatcgacctcgtgctgaagctggagcctgcgtcggcggccgcgccgccgtctggggacgacgaggaagtggccgacggtgtcgcggaggcgcagccgccgtctccggctgctgtcgacgggcagttgaagcggtcgccgagccagagcagcgtggtcaccaccgcgcagccggacgcggaccccgagaagccgcgcgcgcccaaggcgcaggcggtggggtggccgccggtgcggtcgttccggaggaacatgctggcggcggcgctggtgaaggtgagcatggacggcgcgccctacctgcgcaaggtggacatgggcacctacaagagctaccaggagctggagaagatgttcagctccttcaccatcggcaacactccgactcaggggatgacgggcatgaacgagagcaagctggtggacctgctcagcggctccgactacgtgcccacctaccaggacaaggacggcgactggatgctcgtcggcgacgtcccctgggagatgttcgtcgcgtcgtgcaagcgcctccggataatgaaaggatcagaagccatcggcctcgcgccaagggcaatggagaaatgcaagagcaggagctgatcgacgtagtgtccattccaagactacgactctgcttgcccccactctgtaccataatatactactgctacttcgctacgatccggtcaaagttccgttatcgcctcgattagttcactactatctgtataagtacgtatgttccaacttgttgtcatttatacaatgtagtatagtatgtatacgtgagaaagatgtcatcggcatgtcactgtttacgcactacagtagtcaatatatgccttgtcatttcaaaaaaaaaaaaaaaa

SEQ ID NO: 5094 - protein, 240 aa, Triticum aestivum
  misc_feature: PFam Name: AUX_IAA; PFam Description: AUX/IAA family
  misc_feature: GI Number: 53748471; NR Description: auxin resistance protein
  misc_feature: GI Number: 20385508; NR Description: auxin-regulated protein
  misc_feature: GI Number: 5139697; NR Description: expressed in cucumber
  misc_feature: GI Number: 114734; NR Description: AUXIN-INDUCED PROTEIN AUX28 >gi|81759|pir||A28993 auxin-induced protein aux28 - soybean
  misc_feature: GI Number: 4887020; NR Description: Nt-iaa28 deduced protein
MAGLGFEETELRLGLPGGGNEAEEAAAAVRSSGKRGYAETIDLVLKLEPASAAAPPSGDDEEVADGVAEAQPPSPAAVDGQLKRSPSQSSVVTTAQPDADPEKPRAPKAQAVGWPPVRSFRRNMLAAALVKVSMDGAPYLRKVDMGTYKSYQELEKMFSSFTIGNTPTQGMTGMNESKLVDLLSGSDYVPTYQDKDGDWMLVGDVPWEMFVASCKRLRIMKGSEAIGLAPRAMEKCKSRS

SEQ ID NO: 5095 - DNA, 1095 bp, Triticum aestivum
  misc_feature (1)..(1095): Ceres cDNA ID no. 22005564
  misc_feature (1)..(1095): Ceres CLONE  ID no. 633976
  misc_feature (1)..(1095): Also known as  Ceres CDNA ID no. 24412512
gtcattcgatccaccgagctacttagatttcattcgatccattgagctgagccagccatgacgaacgggtacctcttccgggagtacatcggcgcgcagttcaccggcgtccggttctccgacgtgcccgtgaacaccggcgtgagcttccacttcatcctcgccttcgccatcgactacctggcgagccagcagtccaagcccacgccgaccaacggcgtcttcaagccgttctgggacacgggcaacctcaccccggccgccatggccgccaccaaggcggcccaccctaacctgagcatcatggtcagcatcggcggcgacaccgtccagaacacgggcgtcaacgccacctacgccccgacctccgtcgactcgtgggtggccaacgccgtctcctccctctccgccatgatcaaccagtacgggctggacggcgtggacgtggactacgagcacttcggcaccgacgtggacaccttcgtggagggcatcggccgcctgctcacccagctcaaggcccgcttccccaacatccgcacctccatcgcgccctacgagctcccggtcaaccagaagtactaccaggctctgtggaggaagtactccggggtcatcgactacgtcaacttccagttctacggctacggcgccaacaccgtcgtccagtactacgtgcagttctacgacgagcaggcgcgcaactaccccggctccggcggcaccaagctgctcgccagcttcaagaccggcaacgtcaccggcctgctctcgccggatcaaggcatcagcggcgccaaggagctccagcggcagggcaagctgccggggatcttcatcttttcggcggatagctctaagatgagcccctacctgttcaagtatgagacccaggcgcagcagctcgtcgccaaccactaactaagtggtggattcgatccgctaataagtgagtaagacaagtttgctgcatacagcatacgtacggggtcatgtatatcccggatatgtactgggactaaataaatgccgtgtacgtactcaagcttgaataagcggcacctactttggtttgctctaaaaaaaaaaaaaaaa

SEQ ID NO: 5096 - protein, 287 aa, Triticum aestivum
  misc_feature: PFam Name: Glyco_hydro_18; PFam Description: Glycosyl
  misc_feature: PFam Name: Pyr_redox_2; PFam Description: Pyridine
  misc_feature: PFam Name: Pkinase; PFam Description: Protein kinase domain
  misc_feature: PFam Name: Podocalyxin; PFam Description: Podocalyxin
  misc_feature: PFam Name: Mucin; PFam Description: Mucin-like glycoprotein
  misc_feature: GI Number: 11262118; NR Description: chitinase (EC 3.2.1.14) 1 - cone shell (Conus tulipa) gi|6594311|dbj|BAA88408.1| bulb chitinase-1 [Tulipa bakeri] gi|47605559|sp|Q9SLP4|CHI1_TULBA
  misc_feature: GI Number: 7434971; NR Description: chitinase (EC 3.2.1.14) 1
  misc_feature: GI Number: 7434972; NR Description: chitinase (EC 3.2.1.14) 2 - cone shell (Conus tulipa) gi|47605407|sp|Q7M443|CHI2_TULBA
  misc_feature: GI Number: 27462188; NR Description: chitinase [Oryza sativa]
  misc_feature: GI Number: 7434970; NR Description: chitinase (EC 3.2.1.14) a
MTNGYLFREYIGAQFTGVRFSDVPVNTGVSFHFILAFAIDYLASQQSKPTPTNGVFKPFWDTGNLTPAAMAATKAAHPNLSIMVSIGGDTVQNTGVNATYAPTSVDSWVANAVSSLSAMINQYGLDGVDVDYEHFGTDVDTFVEGIGRLLTQLKARFPNIRTSIAPYELPVNQKYYQALWRKYSGVIDYVNFQFYGYGANTVVQYYVQFYDEQARNYPGSGGTKLLASFKTGNVTGLLSPDQGISGAKELQRQGKLPGIFIFSADSSKMSPYLFKYETQAQQLVANH

SEQ ID NO: 5097 - DNA, 1324 bp, Glycine max
  misc_feature (1)..(1324): Ceres cDNA ID no. 22005565
  misc_feature (1)..(1324): Ceres CLONE  ID no. 635455
  misc_feature (1)..(1324): Also known as  Ceres CDNA ID no. 24398664
atcttatccccacccgccacgaccacctgggaatgtcaatgaacgaatggaatgtataaaaccaaccaatagcttcacaatctttcttgcacgccattggtgatcacttccgatagctctcacaatcctatggcggagaacaacaacaaccaccaccttgaaaccgccaccagaaggcttgcctctgtgaccaaccacctcactccttcttcttatcacaacgcacccggcgaactcgccccgtgcctcacttccggtgggaacaacagcttccgccgcgtccacggagaagttccatcccacgacgtcgtttggaggatcgtcgcctccgaccacgacaactccggcaaggacttcaccgacattgtctacgagaaggccgtcggggaaggaatagccaagataagtattaataggccagagagaaggaatgcgttccgaccccacacggtgaaggagcttatgcgtgctttcactgatgccagggatgatagctctattggggtcgtcattctcactggcaagggaaccgaagcattttgtagtggtggtgaccaggctttgaggactaacgatggctattctgataatggaagtttcagtagccttaatgtgttagacttgcaggtgcagatacgccgcctccctaaaccagtgattgcaatggtagcaggttatgctgttggaggagggcatgtattgcatatggtctgtgatctaactattgcagcagataatgctatctttggccaaactggtcccaaggttggaagctttgatgctggttatggaagttctatcatgtcccgtttggtaggtccaaaaaaagcacgtgaaatgtggtttctcacaaggttctatgatgctgttgaagcagagaaaatgggccttgtcaacactgttgtaccacttgagaatttagagaaggaaacgataaaatggtgtcgggagatactgaggaacagtccaactgctattcgggtactcaagtcagctcttaatgcagtggatgatggacattccggacttcaggaaattggtggaaatgcaacactgatatactatggcactgaggaagctaaagagggcaagactgcatatatgcaacgtagacggcctgatttttctaagttcaatcggcgaccttaaatatttgtcaattgtttatatcaatttgagacatggacctctgctctgtccaatatatagagagcagaaagttgatttggcacctgttttctgttgtccttaatttattcatttcaaatgcactttttaggctgatggtaaaataaacagatttcttttaaaaaaaaaaaaaaaa

SEQ ID NO: 5098 - protein, 339 aa, Glycine max
  misc_feature: PFam Name: ECH; PFam Description: Enoyl-CoA
  misc_feature: GI Number: 30696431; NR Description: naphthoate synthase, putative / dihydroxynaphthoic acid synthetase, putative / DHNA
  misc_feature: GI Number: 26450042; NR Description: putative enoyl-CoA
  misc_feature: GI Number: 34912078; NR Description: putative naphthoate synthase [Oryza sativa (japonica cultivar-group)] >gi|20521224|dbj|BAB91741.1| putative naphthoate synthase [Oryza
  misc_feature: GI Number: 2462733; NR Description: Putative enoyl-CoA hydratase/isomerase [Arabidopsis thaliana] >gi|25291844|pir||G96630 probable enoyl-CoA hydratase/isomerase [imported] - Arabidopsis
  misc_feature: GI Number: 32029562; NR Description: COG0447:
MAENNNNHHLETATRRLASVTNHLTPSSYHNAPGELAPCLTSGGNNSFRRVHGEVPSHDVVWRIVASDHDNSGKDFTDIVYEKAVGEGIAKISINRPERRNAFRPHTVKELMRAFTDARDDSSIGVVILTGKGTEAFCSGGDQALRTNDGYSDNGSFSSLNVLDLQVQIRRLPKPVIAMVAGYAVGGGHVLHMVCDLTIAADNAIFGQTGPKVGSFDAGYGSSIMSRLVGPKKAREMWFLTRFYDAVEAEKMGLVNTVVPLENLEKETIKWCREILRNSPTAIRVLKSALNAVDDGHSGLQEIGGNATLIYYGTEEAKEGKTAYMQRRRPDFSKFNRRP

SEQ ID NO: 5099 - DNA, 1007 bp, Glycine max
  misc_feature (1)..(1007): Ceres cDNA ID no. 22005566
  misc_feature (1)..(1007): Ceres CLONE  ID no. 638614
  misc_feature (1)..(1007): Also known as  Ceres CDNA ID no. 24402064
aaatcaacccaacccaacccaaaactcaagctaaattctcactctcacaacttcaatctctttctctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgagacttcgatctcaacatcccggcttttccggatttttcgaccaaggtcggagaagacgaggttgagagccctcaccctgtcatgaagaagcctcgccccttcgtcattcccaagatcgaaatccctcaatatcaatgaactctatgaattttttatttttatttttttcgattattttggagaattttgagatttactataatttgattttgtacatagtcctacctggaagttttgttgaaccgtacgtaccggacccagttctctgatttaggttgtactttcacagtgacagatttgcaattcaattcaatttctttatttaatttaaaaaaaaaaaaaaaa

SEQ ID NO: 5100 - protein, 233 aa, Glycine max
  misc_feature: PFam Name: zf-C2H2; PFam Description: Zinc finger, C2H2 type
  misc_feature: PFam Name: Extensin_2; PFam Description: Extensin-like region
  misc_feature: PFam Name: FH2; PFam Description: Formin Homology 2 Domain
  misc_feature: PFam Name: Pkinase; PFam Description: Protein kinase domain
  misc_feature: PFam Name: Lipoprotein_5; PFam Description: Transferrin
  misc_feature: GI Number: 7488707; NR Description: probable zinc finger protein SCOF-1, cold-inducible - soybean >gi|1763063|gb|AAB39638.1|
  misc_feature: GI Number: 32441471; NR Description: zinc finger protein
  misc_feature: GI Number: 4666360; NR Description: zinc-finger protein 1
  misc_feature: GI Number: 7228329; NR Description: putative TFIIIA (or
  misc_feature: GI Number: 33771374; NR Description: zinc finger protein PIF1
MALETLNSPTTTAPSFPFDDPTIPWAKRKRSKRCSRDHPSEEEYLALCLIMLARGGTTRRVSTPPPQPTPDPSTKLSYKCSVCNKSFPSYQALGGHKASHRKLAASGGEDQPTTTSSAASSANTASGGRTHECSICHKSFPTGQALGGHKRCHYEGNSNGNNNNSNSSVTAASEGVGSTHTVSHGHHRDFDLNIPAFPDFSTKVGEDEVESPHPVMKKPRPFVIPKIEIPQYQ

SEQ ID NO: 5101 - DNA, 1856 bp, Triticum aestivum
  misc_feature (1)..(1856): Ceres cDNA ID no. 22005567
  misc_feature (1)..(1856): Ceres CLONE  ID no. 638993
  misc_feature (1)..(1856): Also known as  Ceres CDNA ID no. 25401041
atgaaaagaagaagaaacccgaagaatggttggtttgagcaagcggtagaaacaagcgtgtcttgtcgttgctataaaggcacacggctgagacgcagaattgttcagtgaagtgcaggggctacactacagagcatcgagcagagcatatggaggcgatcgccggcgacgtccacgcccacggctacggctgggccggggtgtggtcggcggcggccagcctcatcttcctctggtccatggtgcagcagcacctccccgcccagctcgaggagtacctcgccgccctctcccgccgcctccaggcggccatcaccccctacgtcaccatctccatcgacgagcacgtccccgcctccttcggccgcagcgaggcctacctcgccgccgaggcctacctcagcgccacctgcgcctccgccgcccgccgcctccgcgccgacctcgccgccgacagcgaccgcatgagcgtcgccgtcgacgaccacgaggaggtcgccgacgacttccgcggcgccaagctctggtggcgcaagaccaagacgctcccccgcggcaacgtcatcagctggtccgcgcacgaggaggagcgccgcacctactgcctcaccttccaccgccgccaccgcggcctcgtcgacgcgctctacctcccgcacgtcctcgccgagggccgcgccgccaccgtcaggaaccgccagcgccgcctcttcaccaacaaccccagcagcgactggtccggctacgacgcgcgcgtctggagccacgtcaagctcgagcacccctccaccttcgccacgctcggcatgcacccggacaagaagcgggacatcatcgacgacctcgacatgttccgcgacggcaaggactactacgcctccgtcggcaaggcgtggaagcgcggctacctgctcttcgggccccccggcaccggcaagtccaccatgatcgccgccatggcaaagtacctggactacgacgtgtacgacctggagctgacgtcggtgaagaacaacaccgagctgcggaggctcttcatagagaccaagggcaagtccatcatcgtcgttgaggacatcgactgctccctcgacctcaccggcaagcgcaagaagaagaagaagaaaccaaacaagaagaagagcaagagcggcgacaaaaagaagaaggccccgccggcgccaggcgccggcaaggacgaagaaaacaaggtgacgctgtcggggttgctcaatttcatcgacgggctgtggtcggcatgcggcggcgagcggatcatcgtgttcaccaccaaccacaaggagaagctggacccggcactgatccggcggggcaggatggacgtgcacatcgagatgtcatactgctgcttcgagtccttcaaggtgctcgccaagaactacctgcacgtcgacgaccacgagctcttccatgaaatccggcaacttctaggggcggtcaatatgaccccggccgacgtggccgagaacctgatgcccaagtccaaaaagaaggatgtggacacctccctggccaggctggtcaaagcgctcaaggaagcaaaggaggaagcgttggccaaagcactggccggggcagagcacgaagagggagccgaagatgatgacgaggaggaagatgacagcagcagctcgagcgaagaggaggaaaatgggaagaaaaaagaagagtagaatgatatatacgcaatgatatcatagttttttacaagtactcgtatgtatgaaggcaataagaacttgtactcgtacataacatcatcagtttcaaatgagtaaatatatctccaagcacaaaatgtgagatgatgatacggtccaaaaaaaaaaaaaaaa

SEQ ID NO: 5102 - protein, 514 aa, Triticum aestivum
  misc_feature: PFam Name: AAA; PFam Description: ATPase family associated
  misc_feature: PFam Name: Pyr_redox_2; PFam Description: Pyridine
  misc_feature: PFam Name: Podocalyxin; PFam Description: Podocalyxin
  misc_feature: PFam Name: Extensin_2; PFam Description: Extensin-like region
  misc_feature: PFam Name: FH2; PFam Description: Formin Homology 2 Domain
  misc_feature: GI Number: 50510113; NR Description: AAA-type ATPase-like
  misc_feature: GI Number: 55276711; NR Description: ATPase 2 [Hordeum
  misc_feature: GI Number: 55276716; NR Description: ATPase 3 [Hordeum
  misc_feature: GI Number: 61656787; NR Description: Cell Division Protein
  misc_feature: GI Number: 61656809; NR Description: Cell Division Protein
MEAIAGDVHAHGYGWAGVWSAAASLIFLWSMVQQHLPAQLEEYLAALSRRLQAAITPYVTISIDEHVPASFGRSEAYLAAEAYLSATCASAARRLRADLAADSDRMSVAVDDHEEVADDFRGAKLWWRKTKTLPRGNVISWSAHEEERRTYCLTFHRRHRGLVDALYLPHVLAEGRAATVRNRQRRLFTNNPSSDWSGYDARVWSHVKLEHPSTFATLGMHPDKKRDIIDDLDMFRDGKDYYASVGKAWKRGYLLFGPPGTGKSTMIAAMAKYLDYDVYDLELTSVKNNTELRRLFIETKGKSIIVVEDIDCSLDLTGKRKKKKKKPNKKKSKSGDKKKKAPPAPGAGKDEENKVTLSGLLNFIDGLWSACGGERIIVFTTNHKEKLDPALIRRGRMDVHIEMSYCCFESFKVLAKNYLHVDDHELFHEIRQLLGAVNMTPADVAENLMPKSKKKDVDTSLARLVKALKEAKEEALAKALAGAEHEEGAEDDDEEEDDSSSSSEEEENGKKKEE

SEQ ID NO: 5103 - DNA, 1528 bp, Triticum aestivum
  misc_feature (1)..(1528): Ceres cDNA ID no. 22005568
  misc_feature (1)..(1528): Ceres CLONE  ID no. 639221
  misc_feature (1)..(1528): Also known as  Ceres CDNA ID no. 24412584
gttagttctgggcgactccccaggcagcggcggccaagtcaaatccaagtaagaatggcgccgggggagaagaaggggaggaggtggctgccggcggcgtgcctcccgcggcccgggtgcttcacggtgtccgccacggaagaggggccctcgggctccggctccggctccggcgccgatgaggggggcagcagtcgggcgcccacgcatctgatcgtgaccgtcaatggcatcgtcggcagtgcagaaaattggggttacgccgcgaaacatttcatcagaaaacacccggaggatgtggttgttcattgcagtggatgcaactcagcaactcgaactttcgatggtgttgatgtgatgggaaggagattggcggaggaggtgatttcagttgttcagtgtagaccggaacttcagaagatctcctttgttgcacactcattgggtgggttgattgcaagatacgccatagcactactatatgagcctgctacacaaacagattgtcatgaggagtatgagaaggatgtcaatgatgctcggagcaaccaaccgatgggtcaaggcaagattgctggtttggagcccatgaactttataacttttgcaacaccacaccttggcacaagatcacataaacagatgccccttctccgtggttcctatagattggaaaagatggcttttggtatgtcctggcttgctgggagaagtggaaaacatctttttctgaaggatgttgaagatgagaagccaccattacttcttcagatggttactgattatggggatctccatttcatatcagctcttcgttctttcaagcgctgtgttgcttactcaaatgtttgtggtgattttgttgttggctggaagacatcttcaatacgccgtcaacatgagcttcccaagaaagaagattttgtggatgatgtaagatatccacatgttgtatatgtggaaaaaccaaaggctcgggatgttgatttttcggatgaaatgatttatcaggcaaaaactacaagtgaaatggaagaggtaatgctcaaaagcctgaatagaattccttgggaaagggtagatgttagcttcaagagaagtagacaaaggattttcgctcatagcaccattcaggtgaagacgtatttcttcaactctgatggggctgatgtgatcttccacatgatcgaccattttctctactaacatggagcgataatgtggcggtgccaatttctttctcttcttctatttggatgccaatttcaattgggtaggaaaaggatggggtaaaaagtgttggagatatactacagtggaacaggtagaaccacccctggtaaaggagtgctgggcctgggcctatgtatgcttcctgtaaagtctgtctggggctcgtaggttcttttcttttctctcttgcatccatgcttcagtgtgcatgcatgcatgtaaatgtttaatggaccacaggctgttgattcatcagtgtaataaaataagataagatccaaaaaaaaaaaaaaaa

SEQ ID NO: 5104 - protein, 383 aa, Triticum aestivum
MAPGEKKGRRWLPAACLPRPGCFTVSATEEGPSGSGSGSGADEGGSSRAPTHLIVTVNGIVGSAENWGYAAKHFIRKHPEDVVVHCSGCNSATRTFDGVDVMGRRLAEEVISVVQCRPELQKISFVAHSLGGLIARYAIALLYEPATQTDCHEEYEKDVNDARSNQPMGQGKIAGLEPMNFITFATPHLGTRSHKQMPLLRGSYRLEKMAFGMSWLAGRSGKHLFLKDVEDEKPPLLLQMVTDYGDLHFISALRSFKRCVAYSNVCGDFVVGWKTSSIRRQHELPKKEDFVDDVRYPHVVYVEKPKARDVDFSDEMIYQAKTTSEMEEVMLKSLNRIPWERVDVSFKRSRQRIFAHSTIQVKTYFFNSDGADVIFHMIDHFLY

SEQ ID NO: 5105 - DNA, 1084 bp, Triticum aestivum
  misc_feature (1)..(1084): Ceres cDNA ID no. 22005569
  misc_feature (1)..(1084): Ceres CLONE  ID no. 639387
  misc_feature (1)..(1084): Also known as  Ceres CDNA ID no. 24412431
agatcccctatacgcgataccccaatcgaagaagagaggaaaaagaaagcgagctctgcggcggagccatgtccggggccggggagtaccaggagatggccgcgtcggtgccgccggcgctcaaggccatcacgctcacccacgtccgctaccaccggggcgacagggtcggcctcttcctcgcgtgggtctccctaatccccgtcttcatcagcctcggcggcttcatctcccacttcatgttccgccgcgagctgcagggcatctgcttcgccttggggctcctcgtctcgcaggtcctcaacgagctcatcaagcactccgtcgcgcagtcccgcccggcctcgtgcgagctgctcgagacctgcgactcccacggatggccgtccagccacgcgcagtacaccttcttcttcgccacgtacctctcgctcttcgtgctccggaggtcgccggcgagccgcgtcatggccgccttctcatggcctctcgcgttcctcaccatgctctccagggtgtatctcggctaccacaccgtcccgcaggttttcgcgggagcagtagtcggccttgtatttggtgctatctggtactggttcgccaacaccattcttgctcaatacttcccaatgattgaggagagcgcaattgggaggtggttttatatcaaggatacttcacatattcaagatgtgctcaagtttgagtatgataatgcaagggcggcaaggaagaaagttgctactgattgaggattgcaggtttctgctcatggattatatggttggtctatctcagggagggtaagaacttgtgtggcatggcaagatgtttgcttcgttgaagctgcacgcgaacccatgtactcctagctggacttttattagaagagaagcccattggagttgtggtgttttttttgcttttcctggccataagccattgttctttttaaccccagacccttgtattcatttggcgatgagttgattttcgtttacatttggacaaagaccacagcttttttgtactcgactgaattatatctgtgccatatattgttcatacaaaaaaaaaaaaaaaa

SEQ ID NO: 5106 - protein, 1084 aa, Triticum aestivum
  misc_feature: PFam Name: PAP2; PFam Description: PAP2 superfamily
  misc_feature: PFam Name: Vitellogenin_N; PFam Description: Lipoprotein
  misc_feature: GI Number: 38564298; NR Description: At5g03080 [Arabidopsis thaliana] >gi|46402486|gb|AAS92345.1| At5g03080 [Arabidopsis thaliana] >gi|15242619|ref|NP_195928.1| phosphatidic acid
  misc_feature: GI Number: 31206587; NR Description: ENSANGP00000002778 [Anopheles gambiae] >gi|21296031|gb|EAA08176.1| ENSANGP00000002778
  misc_feature: GI Number: 28829339; NR Description: similar to Mus musculus
  misc_feature: GI Number: 20072969; NR Description: Dolichyl pyrophosphate
  misc_feature: GI Number: 62644867; NR Description: PREDICTED: similar to contains transmembrane (TM) region and ATP binding region [Rattus
AGATCCCCTATACGCGATACCCCAATCGAAGAAGAGAGGAAAAAGAAAGCGAGCTCTGCGGCGGAGCCATGTCCGGGGCCGGGGAGTACCAGGAGATGGCCGCGTCGGTGCCGCCGGCGCTCAAGGCCATCACGCTCACCCACGTCCGCTACCACCGGGGCGACAGGGTCGGCCTCTTCCTCGCGTGGGTCTCCCTAATCCCCGTCTTCATCAGCCTCGGCGGCTTCATCTCCCACTTCATGTTCCGCCGCGAGCTGCAGGGCATCTGCTTCGCCTTGGGGCTCCTCGTCTCGCAGGTCCTCAACGAGCTCATCAAGCACTCCGTCGCGCAGTCCCGCCCGGCCTCGTGCGAGCTGCTCGAGACCTGCGACTCCCACGGATGGCCGTCCAGCCACGCGCAGTACACCTTCTTCTTCGCCACGTACCTCTCGCTCTTCGTGCTCCGGAGGTCGCCGGCGAGCCGCGTCATGGCCGCCTTCTCATGGCCTCTCGCGTTCCTCACCATGCTCTCCAGGGTGTATCTCGGCTACCACACCGTCCCGCAGGTTTTCGCGGGAGCAGTAGTCGGCCTTGTATTTGGTGCTATCTGGTACTGGTTCGCCAACACCATTCTTGCTCAATACTTCCCAATGATTGAGGAGAGCGCAATTGGGAGGTGGTTTTATATCAAGGATACTTCACATATTCAAGATGTGCTCAAGTTTGAGTATGATAATGCAAGGGCGGCAAGGAAGAAAGTTGCTACTGATTGAGGATTGCAGGTTTCTGCTCATGGATTATATGGTTGGTCTATCTCAGGGAGGGTAAGAACTTGTGTGGCATGGCAAGATGTTTGCTTCGTTGAAGCTGCACGCGAACCCATGTACTCCTAGCTGGACTTTTATTAGAAGAGAAGCCCATTGGAGTTGTGGTGTTTTTTTTGCTTTTCCTGGCCATAAGCCATTGTTCTTTTTAACCCCAGACCCTTGTATTCATTTGGCGATGAGTTGATTTTCGTTTACATTTGGACAAAGACCACAGCTTTTTTGTACTCGACTGAATTATATCTGTGCCATATATTGTTCATACAAAAAAAAAAAAAAAA

SEQ ID NO: 5107 - DNA, 1883 bp, Triticum aestivum
  misc_feature (1)..(1883): Ceres cDNA ID no. 22005570
  misc_feature (1)..(1883): Ceres CLONE  ID no. 639907
  misc_feature (1)..(1883): Also known as  Ceres CDNA ID no. 23414332
ataattcccacccaaaggaaagcaaaatattcccatcccaccggcaccacctcctcctccccaagtcaagccccatcgtctcttcagtgttcactggttatcttggaaggacggagaaaccatacagactagactaccatgtcaggaggatcggatgtatcttcaccatcatcgggacgaattagcacgagttctttgtcagacttgaaggacttggagctttcttcagagtctggctgcttgtccattgttgtactaggtgcttctggggaccttgctaaaaagaaaacttttccagcactcttcaacctttttcaacagggatttatacaatctggagaagtccatatatttgggtatgcaagatcagatatatctgatgaagggttaagagaacgcattcgtggatatctcaaaggagcttcagatgaacatctttcacaatttttgcaattaattaagtatgttagtggttcatatgataatggggcaggatttgaattgctaaacaagacaatctctgagaatgaaacatcagagaacaaccaaccaggaaactcccgaagactattttatttggcattacctccttcagtgtacccctcagtatgcaaaatgataagatcatattgcatgactccatcctctcatactggttggacaagggttattgttgaaaagcccttcggaaaggatttagactctgctgaggaattgagtgcccaacttggagagcttttcgatgaagaacaactatatagaattgaccactatttaggaaaggagttggtccaaaacttgctcgtgcttcgctttgcaaaccgcttttttctgcccctctggaatcataacattgataacgtacagattgtattccgggaggacttcggaactgatggacgtggaggatattttgatcaatatggtatcattcgggatatcattcagaaccatttgctgcaggtcttttgtttggtagccatggaaaagcctgtctctcttagtcctgagcacataagagatgagaaagtcaaggttctgcaatcagtgagctgtataaaccatgacgaggtagtccttgggcaatatgatggctacaaggatgatccgacagtgccaaatgaatccaacacgcctacttttgcgtccgttgtactgagggtacacaatgagagatgggatggagttcctttcgtccttaaggctggtaaagcactaagctctaagaaagcagagatacgtgtgcagttcaaggatgctccgggcgatatttttagatgcaagaaacaaggaagaaatgaatttgtcatacgcctgcagccatcggaagccatgtatatgaaattaactgtaaagaaaccagggctcgaaatggcaacagaacagagcgaactggatttatcctatgggctacggtaccaagatgtaaaaatcccagaagcgtacgagcgtcttatcttggacacggtaagaggtgaccagcagcactttgttcgccgagatgagctcaaggctgcctgggagatcttcactcctttgttgcacgacatcgatgctggcaggctcaaggctctgccataccaaccgggaacccggggtcctctggaggccgatgagttgagcaagaggatggggtacgtgccgactcttggctatgtttgggcaccgccaactcttgcaaagttttagccgctaccaagtgccggttaagaacaggagcgttgtgggtttacagagaattacttcagagggaaattacttgctctgtatgttatatatggagagcatttgtaataagcagtctctgcttttcaaaacagtgtaccattttacgattataaataaatgatactaccatcttgttaaaaaaaaaaaaaaaaaaa

SEQ ID NO: 5108 - protein, 1883 aa, Triticum aestivum
  misc_feature: PFam Name: G6PD_C; PFam Description: Glucose-6-phosphate
  misc_feature: PFam Name: G6PD_N; PFam Description: Glucose-6-phosphate
  misc_feature: GI Number: 66361518; NR Description: Chain B, X-Ray Structure Of Human Glucose-6-Phosphate Dehydrogenase (Deletion Variant) Complexed With Glucose-6-Phosphate >gi|66361517|pdb|2BHL|A Chain A, X-Ray Structure Of Human Glucose-6-Phosphate
  misc_feature: GI Number: 57112887; NR Description: PREDICTED: similar to
  misc_feature: GI Number: 471345; NR Description: glucose-6-phosphate 1-dehydrogenase [Solanum tuberosum] >gi|585165|sp|P37830|G6PD_SOLTU Glucose-6-phosphate 1-dehydrogenase, cytoplasmic isoform (G6PD)
  misc_feature: GI Number: 21262179; NR Description: glucose-6-phosphate
  misc_feature: GI Number: 3021508; NR Description: glucose-6-phosphate
ATAATTCCCACCCAAAGGAAAGCAAAATATTCCCATCCCACCGGCACCACCTCCTCCTCCCCAAGTCAAGCCCCATCGTCTCTTCAGTGTTCACTGGTTATCTTGGAAGGACGGAGAAACCATACAGACTAGACTACCATGTCAGGAGGATCGGATGTATCTTCACCATCATCGGGACGAATTAGCACGAGTTCTTTGTCAGACTTGAAGGACTTGGAGCTTTCTTCAGAGTCTGGCTGCTTGTCCATTGTTGTACTAGGTGCTTCTGGGGACCTTGCTAAAAAGAAAACTTTTCCAGCACTCTTCAACCTTTTTCAACAGGGATTTATACAATCTGGAGAAGTCCATATATTTGGGTATGCAAGATCAGATATATCTGATGAAGGGTTAAGAGAACGCATTCGTGGATATCTCAAAGGAGCTTCAGATGAACATCTTTCACAATTTTTGCAATTAATTAAGTATGTTAGTGGTTCATATGATAATGGGGCAGGATTTGAATTGCTAAACAAGACAATCTCTGAGAATGAAACATCAGAGAACAACCAACCAGGAAACTCCCGAAGACTATTTTATTTGGCATTACCTCCTTCAGTGTACCCCTCAGTATGCAAAATGATAAGATCATATTGCATGACTCCATCCTCTCATACTGGTTGGACAAGGGTTATTGTTGAAAAGCCCTTCGGAAAGGATTTAGACTCTGCTGAGGAATTGAGTGCCCAACTTGGAGAGCTTTTCGATGAAGAACAACTATATAGAATTGACCACTATTTAGGAAAGGAGTTGGTCCAAAACTTGCTCGTGCTTCGCTTTGCAAACCGCTTTTTTCTGCCCCTCTGGAATCATAACATTGATAACGTACAGATTGTATTCCGGGAGGACTTCGGAACTGATGGACGTGGAGGATATTTTGATCAATATGGTATCATTCGGGATATCATTCAGAACCATTTGCTGCAGGTCTTTTGTTTGGTAGCCATGGAAAAGCCTGTCTCTCTTAGTCCTGAGCACATAAGAGATGAGAAAGTCAAGGTTCTGCAATCAGTGAGCTGTATAAACCATGACGAGGTAGTCCTTGGGCAATATGATGGCTACAAGGATGATCCGACAGTGCCAAATGAATCCAACACGCCTACTTTTGCGTCCGTTGTACTGAGGGTACACAATGAGAGATGGGATGGAGTTCCTTTCGTCCTTAAGGCTGGTAAAGCACTAAGCTCTAAGAAAGCAGAGATACGTGTGCAGTTCAAGGATGCTCCGGGCGATATTTTTAGATGCAAGAAACAAGGAAGAAATGAATTTGTCATACGCCTGCAGCCATCGGAAGCCATGTATATGAAATTAACTGTAAAGAAACCAGGGCTCGAAATGGCAACAGAACAGAGCGAACTGGATTTATCCTATGGGCTACGGTACCAAGATGTAAAAATCCCAGAAGCGTACGAGCGTCTTATCTTGGACACGGTAAGAGGTGACCAGCAGCACTTTGTTCGCCGAGATGAGCTCAAGGCTGCCTGGGAGATCTTCACTCCTTTGTTGCACGACATCGATGCTGGCAGGCTCAAGGCTCTGCCATACCAACCGGGAACCCGGGGTCCTCTGGAGGCCGATGAGTTGAGCAAGAGGATGGGGTACGTGCCGACTCTTGGCTATGTTTGGGCACCGCCAACTCTTGCAAAGTTTTAGCCGCTACCAAGTGCCGGTTAAGAACAGGAGCGTTGTGGGTTTACAGAGAATTACTTCAGAGGGAAATTACTTGCTCTGTATGTTATATATGGAGAGCATTTGTAATAAGCAGTCTCTGCTTTTCAAAACAGTGTACCATTTTACGATTATAAATAAATGATACTACCATCTTGTTAAAAAAAAAAAAAAAAAAA

SEQ ID NO: 5109 - DNA, 1562 bp, Triticum aestivum
  misc_feature (1)..(1562): Ceres cDNA ID no. 22005571
  misc_feature (1)..(1562): Ceres CLONE  ID no. 644395
  misc_feature (1)..(1562): Also known as  Ceres CDNA ID no. 23464873
cgtggtcactccccgtcccatttcccccatcccccatccccgctagggttttccaccatggcgtcggcgtcgcgcgcgctcctcctctccagggcctcgcccctccacgccgccgcctcccgcttcctccgcccggtcgcggccgcggggagcctcctcccggcggcgctggtcccgtcccccgccgcggcgccctgggcggcggcgaggcgattcgcgacgcagcccgcgaactcgtcgctgcgggactcgtccccgaactggagcaaccgcccgcccaaggagacgatcctcctcgacggctgcgacttcgagcactggctcgtcgtcatggagccgcccccaggcgacggcgccaaccccgacgtcacccgcgacgagatcatcgacgggtacatcaagaccctcgcccaggtcgtcggaagtgaagacgaagcaaggatgaagatctactctgtgtcaactaggcattattttgcttttggtgccctagtatctgaggaactctcctacaaactcaaagagttgcctaaagtccgttgggttcttcctgattcatacctggacgtcagaaataaggactatggaggagaaccatttatagatggacaagctgttccttacgaccccaaataccatgaggagtgggtgagaaacaatgcccgtgccaatgaaagatcccggcgcaatgacaggcctcgcaactttgacaggtcgaggaactttgaaaggagaagggagaacacacaggcctaccagagtgggcctccaaaccaaatgccaccccatgatgctgctcctccaagtcgtggtgcacagggcccgccaccgccttcaggtgctccaccaaattaccagccccatgcaccaaacccacaggcaggctatgctgcaggaggtggaccaaactatccaaatgcaccaccaccccctggataccgaggtgccccagcccctggctaccaagctggtaaccaaggttaccagggtaatcctggtggcaacatgcacaatggaccaggcccagcctaccatagcaacaaccctggataccagggtggagtgccaggaggcaacccgccgccacctttcgcaggtggcaaccagcctcctccctaccatggcggtggtcctagctatggtggtggtgcaccagactaccagggccaaccaggtggtaacccaggctaccaaggtggcggtaactacagcaacgccgcccctcctccctatgagggcagggacgggccagggaggaactaccagtagagaagactggtagaagagcgctgtgtaggaagttagtaagagctatgctcgagtcgccctatgttgttctcgtggacttttatgcatatattctctatccatcatggtgttttgagaactagaactactgcaagcttaggtaagaagtgctttgtttttttctctttgtcgaaataaatacaatgctgactatcgtatggaaccagagctttgttatttgttgccgtattgtaatagcaacatgttctgtgtgttctattgaatcacttttatattcaaaaaaaaaaaaaaaa

SEQ ID NO: 5110 - protein, 403 aa, Triticum aestivum
  misc_feature: PFam Name: Extensin_2; PFam Description: Extensin-like region
  misc_feature: PFam Name: FH2; PFam Description: Formin Homology 2 Domain
  misc_feature: PFam Name: GRP; PFam Description: Glycine rich protein family
  misc_feature: PFam Name: Pyr_redox_2; PFam Description: Pyridine
  misc_feature: PFam Name: DivIVA; PFam Description: DivIVA protein
  misc_feature: GI Number: 50726526; NR Description: putative plastid protein [Oryza sativa (japonica cultivar-group)] >gi|47848437|dbj|BAD22293.1| putative plastid protein [Oryza sativa
  misc_feature: GI Number: 28394075; NR Description: putative DAG protein [Arabidopsis thaliana] >gi|27754695|gb|AAO22791.1| putative DAG protein [Arabidopsis thaliana] >gi|42572295|ref|NP_974243.1|
  misc_feature: GI Number: 7549634; NR Description: DAG protein, putative [Arabidopsis thaliana] >gi|15230785|ref|NP_187335.1| plastid
  misc_feature: GI Number: 50901218; NR Description: putative chloroplast differentiation and palisade development-related protein [Oryza sativa (japonica cultivar-group)] >gi|41469316|gb|AAS07172.1| putative chloroplast differentiation and palisade
  misc_feature: GI Number: 2440029; NR Description: DAL1 protein [Arabidopsis thaliana] >gi|2440031|emb|CAA75115.1| DAL1 protein [Arabidopsis
MASASRALLLSRASPLHAAASRFLRPVAAAGSLLPAALVPSPAAAPWAAARRFATQPANSSLRDSSPNWSNRPPKETILLDGCDFEHWLVVMEPPPGDGANPDVTRDEIIDGYIKTLAQVVGSEDEARMKIYSVSTRHYFAFGALVSEELSYKLKELPKVRWVLPDSYLDVRNKDYGGEPFIDGQAVPYDPKYHEEWVRNNARANERSRRNDRPRNFDRSRNFERRRENTQAYQSGPPNQMPPHDAAPPSRGAQGPPPPSGAPPNYQPHAPNPQAGYAAGGGPNYPNAPPPPGYRGAPAPGYQAGNQGYQGNPGGNMHNGPGPAYHSNNPGYQGGVPGGNPPPPFAGGNQPPPYHGGGPSYGGGAPDYQGQPGGNPGYQGGGNYSNAAPPPYEGRDGPGRNYQ

SEQ ID NO: 5111 - DNA, 1554 bp, Triticum aestivum
  misc_feature (1)..(1554): Ceres cDNA ID no. 22005572
  misc_feature (1)..(1554): Ceres CLONE  ID no. 644415
  misc_feature (1)..(1554): Also known as  Ceres CDNA ID no. 24404261
ccaagactcggaggagaggtcagggagagaggagggaggcgagagaggcggcgcgttcccaatccgcacgcacgtacgagtccgctcgccctcccccgtcgctacccgccggccacccggcgagggacacgagacccgcggcaggcggcggcacttgcgagatcgcgcgcatcggtcccatcatcgtccccagccaggcaaggcaagggcaggcggctgagagcgctataagaccgagagactgaggcgtggggtgcagccatgccgacggcgcaggggattggtttgaagcacgcgacgccgacgggcgtcggccgcagggcccggcgcagccacgccgcgtccgcgcatggccgctccgcgaggcaggcgcacggtgccatgtctctggagggcggcgggttcctcggcggcgcgcaccgcatcgaggaacgcgtcgcgccatgcccgcctcgggccgcggcgcgtgacgcagagtcgatacggcccatgtctctgctacccgagagcagcattgggctctacaacccggcgttcgagcgtgactcgtgcggcgttggtttcgtcgccgagctgtcgggcgttgacaaccgggcgaccgtcgtcgatgccattcagatgcttgaaagaatggcacaccgaggtgcctgcggctgtgagaaaaacactggtgatggtgccggcattctcgttgctctaccacacaacttcttccgagaggtgacaaaggatgccggtttcgagttaccgccaccaggtgagtatgctgttggaatggtcttcctgccaaccgatgagaagcgccgcgagaggagcaaaactgagtttacaaaggtcgctgagtcgctaggacattcgatacttgggtggcgccaggttcccactgacaattcagacttgggccaagctgcgctcgacactgaaccagcgattgaacaggttttcctcacaaagagttcaaaatcgaaggccgacttcgaacagcagttgtttatcctgaggaggctctcaattgtatctatccgggccgcgctgaatcttaagcgtggaggagagagagatttctacatgtgctctctatcttcaaggaccattgtctacaagggccagcttatgccgtctcagcttcaggggtactactatgcggacataggtcatgaaaacttctccagttatatggctctggtaaatacgaaaccttgatactcttacaacaaaagtcatggtcgtagtcagcggacgggaatcaataatagcaagccagttgtaagatcaagactcgctcctgtgcagacatcaaatttgagctgtctattcatatgctatttcagtcctgcttcgtgatgcctttaagtgaagtactagaaacttctcttagttgatacccgataaccatgttgcagagtccagctgcagttctgctatggccgactgcttgccgactcttcaggatgtgaccgaagaaattgtgtttggtttgaggtagcttagggctcccaactgttttgcatgaaattatacgcagctgatgtatttttaaaaaaaaaaaaaaaa

SEQ ID NO: 5112 - protein, 313 aa, Triticum aestivum
  misc_feature: PFam Name: GATase_2; PFam Description: Glutamine
  misc_feature: GI Number: 4008156; NR Description: NADH dependent Glutamate
  misc_feature: GI Number: 34911200; NR Description: NADH-dependent glutamate synthase [Oryza sativa (japonica cultivar-group)] >gi|21644701|dbj|BAC01257.1| NADH-dependent glutamate synthase
  misc_feature: GI Number: 8843775; NR Description: NADH-dependent glutamate
  misc_feature: GI Number: 30696340; NR Description: glutamate synthase
  misc_feature: GI Number: 62177687; NR Description: NADH glutamate synthase
MPTAQGIGLKHATPTGVGRRARRSHAASAHGRSARQAHGAMSLEGGGFLGGAHRIEERVAPCPPRAAARDAESIRPMSLLPESSIGLYNPAFERDSCGVGFVAELSGVDNRATVVDAIQMLERMAHRGACGCEKNTGDGAGILVALPHNFFREVTKDAGFELPPPGEYAVGMVFLPTDEKRRERSKTEFTKVAESLGHSILGWRQVPTDNSDLGQAALDTEPAIEQVFLTKSSKSKADFEQQLFILRRLSIVSIRAALNLKRGGERDFYMCSLSSRTIVYKGQLMPSQLQGYYYADIGHENFSSYMALVNTKP

SEQ ID NO: 5113 - DNA, 1015 bp, Glycine max
  misc_feature (1)..(1015): Ceres cDNA ID no. 22005574
  misc_feature (1)..(1015): Ceres CLONE  ID no. 665486
  misc_feature (1)..(1015): Also known as  Ceres CDNA ID no. 24403619
ataaacatatatatatctgatactctcacgtttcacgcgtccttctcccaccgcaccccacacttccggcaccgtcggaactcagcaccgcacatctgcaccccacactcgtcttctcacaaccgtcaatcgcagtcacagcgcacagcttcgagttcagaggtcccccccttcactgcaacgttttcaccttgatttcttcagctctagttctctctcacaagctttctccagctttgcaactagctttgtctgactctggcatatatttttgttcttcagaaaaatactaatggattcatcacaaagtgcggctcttgggggaaatggtgggagtggtggaaatgggacgttgatttctcaaattaatgacatggcagcctctgcaacaggagctgatgattctatgcagaagctgaaccaggtcagcaactccattcagaaaaccttgggccttatccatcagctttacctcacagtttctaccttcaatgctgcctttcaaatgcctctcctccaacgcatcaatggccttgttgcggagcttgacaacatggttaaattggcagagaagtgcaacattcaggttcctatggaggttgtcaatttaattgatgatggaaagaatccagacgaatttaccaaagatgttataaacagctgtattgcaaagaatcagatcaccaaaggaaaaactgatgctttaaagagtttgcgcaaacatcttttggaggaattggagcagaacttccctgatgaggttgaaacttttagagagagtcgtactgctgcagctgctgagttgaaacgtcaggcacaaagcgcactgccaaatggagatgtgagagttaaatcagagcattgagtgatatatttcttgtgtcttctagcgtttatgtatgcactgtatagtggagttcagcactgttccttgtttctgcatgttggttaaatgctgtaaatttgatgactaatttttgcttactattaattacttacaaaaaaaaaaaaaaaa

SEQ ID NO: 5114 - protein, 190 aa, Glycine max
  misc_feature: GI Number: 25403266; NR Description: protein T24P13.4 [imported] - Arabidopsis thaliana >gi|9295719|gb|AAF87025.1|
  misc_feature: GI Number: 31216855; NR Description: ENSANGP00000021242 [Anopheles gambiae] >gi|21299427|gb|EAA11572.1| ENSANGP00000021242
  misc_feature: GI Number: 34873422; NR Description: similar to DNA segment,
  misc_feature: GI Number: 47937479; NR Description: MGC78921 protein
  misc_feature: GI Number: 49522360; NR Description: MGC89063 protein [Xenopus tropicalis] >gi|52345736|ref|NP_001004914.1| MGC89063
MDSSQSAALGGNGGSGGNGTLISQINDMAASATGADDSMQKLNQVSNSIQKTLGLIHQLYLTVSTFNAAFQMPLLQRINGLVAELDNMVKLAEKCNIQVPMEVVNLIDDGKNPDEFTKDVINSCIAKNQITKGKTDALKSLRKHLLEELEQNFPDEVETFRESRTAAAAELKRQAQSALPNGDVRVKSEH

SEQ ID NO: 5115 - DNA, 1406 bp, Triticum aestivum
  misc_feature (1)..(1406): Ceres cDNA ID no. 22005575
  misc_feature (1)..(1406): Ceres CLONE  ID no. 677748
  misc_feature (1)..(1406): Also known as  Ceres CDNA ID no. 24412560
tacctatcttttctgttagaccattcgacgccacgtccgcgcgcgtcacggcgcagcgagcagcccggccggccggccgattataaaacctcagtgcgagcaggtgctccactcgcactgccactccacccgttacctctgctactcgaacttcattcgcggatcagatcagatcagatcaccatgggctcctacgttcagggtgaggatgaagttcccgtctatgaatcgggtgcacatgccctgcagaagctgcaagagaaatggaagtccacggcggcgccgtacccggccatgtactcgagcttcttgggcgggatcatcctggacccggccatgatggccctccccatcgacgaccacatggcccaccgcggccacggcgtcttcgacacggccatgctcctcgacggccacctctacgagctcgacgcgcacctcgaccgcttcctgcgctccgcggcgcaggccaaggtgggcaccccgttcccgcgcgacacgctgcgcagcatcctcgtgcagatgacggcggcgtccggctgccggaagggctccatccggtactggctgagctccggcccgggcgacttcctgctctcctccagcggctgtcccggcccggccttctacgccgtggcgatcccgtccgactacgcgcagtgccgcgacggcgtgcgcgccgtgaccacgtcggtgcccatgaagccgccgctgttcgccaccatgaagaacgtcaactacctccctaatgtgctgtccatcatggacgccgaggagcgcggcgcgttcgcgtccgtgtgggtggacgagcaggggtacgtcgccgaggggcccatggtgaacgtcgccttcgtcacccagggcggcgagctcgtgctccctgtgttcgacaagatcctcagcgggtgcacagccaagcggatgctggcgctggcgccgaagctcgtggaggctggcctgctcaagggcgtcagcacccagcacatcaccgccgacgacgccaagcgctccgtggagatggcctttgtcggcagcggcctgcccgtgctgcccatcgtcgagtgggacggccagcccatcggcgacgggaaggtggggaagctgatgctggcgctgtccgatctgctctgggaggacatgaagtccgggccggacagggtcgccgttccatacaagtgatccaggggaagggaacgctagagagatggcgtgtgcatgcgcaagcacgggcacgttcgtgcgtgtacaagatagtgtgtgagccgagccgcaatttgttgcccgtactgtttgtcacttgacttgtcaagccctgtataactgtggtatgtgtgtgccggatggatgactcaccaaataaataatactacgatcttgggtctttcgcggtaaaaaaaaaaaaaaaa

SEQ ID NO: 5116 - protein, 331 aa, Triticum aestivum
  misc_feature: PFam Name: Aminotran_4; PFam Description: Aminotransferase
  misc_feature: GI Number: 56784110; NR Description: branched-chain amino acid aminotransferase -like [Oryza sativa (japonica
  misc_feature: GI Number: 34904468; NR Description: putative branched-chain amino acid aminotransferase protein [Oryza sativa (japonica cultivar-group)] >gi|11034702|dbj|BAB17203.1| putative branched-chain amino acid aminotransferase protein [Oryza sativa
  misc_feature: GI Number: 22136392; NR Description: branched-chain amino acid aminotransferase-like protein [Arabidopsis thaliana] >gi|20466634|gb|AAM20634.1| branched-chain amino acid aminotransferase-like protein [Arabidopsis thaliana]
  misc_feature: GI Number: 9758354; NR Description: branched-chain amino acid
  misc_feature: GI Number: 50345543; NR Description:
MGSYVQGEDEVPVYESGAHALQKLQEKWKSTAAPYPAMYSSFLGGIILDPAMMALPIDDHMAHRGHGVFDTAMLLDGHLYELDAHLDRFLRSAAQAKVGTPFPRDTLRSILVQMTAASGCRKGSIRYWLSSGPGDFLLSSSGCPGPAFYAVAIPSDYAQCRDGVRAVTTSVPMKPPLFATMKNVNYLPNVLSIMDAEERGAFASVWVDEQGYVAEGPMVNVAFVTQGGELVLPVFDKILSGCTAKRMLALAPKLVEAGLLKGVSTQHITADDAKRSVEMAFVGSGLPVLPIVEWDGQPIGDGKVGKLMLALSDLLWEDMKSGPDRVAVPYK

SEQ ID NO: 5117 - DNA, 632 bp, Triticum aestivum
  misc_feature (1)..(632): Ceres cDNA ID no. 22005576
  misc_feature (1)..(632): Ceres CLONE  ID no. 678245
  misc_feature (1)..(632): Also known as  Ceres CDNA ID no. 23475062
acagcatctgcacactccgcctcccgcctcttgcagcctaaccccacctctcgagtctcgacaccctcgaatcagcgtccatggcacccaaggcggagaagaagccggtggccacggagaaggctccagcggggaagaagcccaaggcagagaagcggccgccggcgtccaaggagggcggcgagaagaagggcaagaagaagtccaagaagagcgtggagacgtacaagatctacatcttcaaggtgctcaagcaggtgcacccggacatcggcatctcctccaaggccatgtccatcatgaactccttcatcaacgacatcttcgagaagctcgccggcgagcttctcgaagatgtcgttgatgaagaagagagaggagatgtccagtgtcctcaggaagatgagatctgctggaactggaaccgagaagaagaaatagagcatcccaggctcatgaagttgatggaaaatcttctgttctggtgtccggtttttactgcatgtagaacctgctagacttgaaactgttatccgccagctaaacattatgctatgttgaacctcctgtcttgtgagatttttgagctaacttgcaatgcatcgtttgccaccccaaaaaaaaaaaaaaaa

SEQ ID NO: 5118 - protein, 145 aa, Triticum aestivum
  misc_feature: PFam Name: Histone; PFam Description: Core histone H2A/H2B/H3/H4
  misc_feature: PFam Name: TT_ORF1; PFam Description: TT viral orf 1
  misc_feature: PFam Name: Protamine_P1; PFam Description: Protamine P1
  misc_feature: GI Number: 531058; NR Description: protein H2B-8 [Triticum
  misc_feature: GI Number: 531054; NR Description: protein H2B153 [Triticum
  misc_feature: GI Number: 21801; NR Description: histone H2B [Triticum aestivum] >gi|122022|sp|P27807|H2B1_WHEAT Histone H2B
  misc_feature: GI Number: 22323; NR Description: H2B histone [Zea mays] >gi|399853|sp|P30755|H2B1_MAIZE Histone H2B.1
  misc_feature: GI Number: 22325; NR Description: H2B histone [Zea mays] >gi|399854|sp|P30756|H2B2_MAIZE Histone H2B.2
MAPKAEKKPVATEKAPAGKKPKAEKRPPASKEGGEKKGKKKSKKSVETYKIYIFKVLKQVHPDIGISSKAMSIMNSFINDIFEKLAGELLEDVVDEEERGDVQCPQEDEICWNWNREEEIEHPRLMKLMENLLFWCPVFTACRTC

SEQ ID NO: 5119 - DNA, 1184 bp, Triticum aestivum
  misc_feature (1)..(1184): Ceres cDNA ID no. 22005578
  misc_feature (1)..(1184): Ceres CLONE  ID no. 685394
  misc_feature (1)..(1184): Also known as  Ceres CDNA ID no. 24409830
aaaccaaaacccccgcgagaaccttcctcctctcctcttctcaccgacaaccgtcgctcatggaggccaccgccgcgtcgacgcggcctctcttcctcctggcgccttcgccgccgctggtcagcacggtgcggctcgcccttggcgtggggaggcgccggttcgtggtcgcgggggccaggaagaagagggggcggcaggacggggaggcgggggaggagagggtggacgcgcacagcttcaaccccaaggccggcgaggtcaccgggccgttccccgaggccgtgcttctcagaaagaaaaaggtgaaagaggacggtgaagctttgccagaattcgcggacgccgaagaagaaaagctatacgagcttcttaacattcagctagagagtggtttaaatctgcaaagaatgcgacactatgaagttgtttacctcattcacgaggaccgcgtggaagaagttgaagacgttgtatcaaaagtacaagactttatcagagagaagaaaggaaggatttggagggtgaacaactggggactgcgcagacttgcttacaagataaagaaagcaacacatgccaactacatcctaatgaactttgagatacaggcacaatccataaacgagttcaagactctgctagataaggatgaaagaatcattagacaccttgtgatgaaacgagatgaggcgattactgaagattgccctcctccaccagagttccatgctatgcgatctcaacagttggatgacgagtatattgatgaggaatatgggagggtggacgatggggatgatgaggctgaactagagtcttttggcaatgttgacgatgacgttgaagatggcgatgaacctgaaatcattcttgttgatgaagttgacgatgacaatgccgaagacctcagaagaagaaataggaaggtgaaactggagaagtataccgtggagaaggtcttgaggtagcatgcgtatctactgtatggtttagttcttatacaaaggaacacttgtacgatgaagtaattacattaggtgttttccctgtatcggtgaccactattacgatggtagtaattagtgagataagctcatcaggtcttctccctaaatcttgagctgttgttgtttttccaaattatgtggtatgatcattcccttggaaaaaaaaaaaaaaaa

SEQ ID NO: 5120 - protein, 303 aa, Triticum aestivum
  misc_feature: PFam Name: Ribosomal_S6; PFam Description: Ribosomal protein S6
  misc_feature: PFam Name: S1; PFam Description: S1 RNA binding domain
  misc_feature: GI Number: 21553777; NR Description: unknown [Arabidopsis thaliana]
  misc_feature: GI Number: 49076654; NR Description: PA4935 [synthetic construct]
  misc_feature: GI Number: 15600128; NR Description: 30S ribosomal protein S6 [Pseudomonas aeruginosa PA01] >gi|9951214|gb|AAG08320.1| 30S ribosomal protein S6 [Pseudomonas aeruginosa PAO1] >gi|13959534|sp|Q9HUM9|RS6_PSEAE 30S ribosomal protein S6
  misc_feature: GI Number: 48861101; NR Description: COG0360: Ribosomal
  misc_feature: GI Number: 15677189; NR Description: 30S ribosomal protein S6 [Neisseria meningitidis MC58] >gi|13959510|sp|Q9JZ29|RS6_NEIMB 30S ribosomal protein S6 >gi|11276542|pir||B81097 30S ribosomal protein S6 NMB1323 [imported] - Neisseria meningitidis (strain
MEATAASTRPLFLLAPSPPLVSTVRLALGVGRRRFVVAGARKKRGRQDGEAGEERVDAHSFNPKAGEVTGPFPEAVLLRKKKVKEDGEALPEFADAEEEKLYELLNIQLESGLNLQRMRHYEVVYLIHEDRVEEVEDVVSKVQDFIREKKGRIWRVNNWGLRRLAYKIKKATHANYILMNFEIQAQSINEFKTLLDKDERIIRHLVMKRDEAITEDCPPPPEFHAMRSQQLDDEYIDEEYGRVDDGDDEAELESFGNVDDDVEDGDEPEIILVDEVDDDNAEDLRRRNRKVKLEKYTVEKVLR

SEQ ID NO: 5121 - DNA, 1534 bp, Triticum aestivum
  misc_feature (1)..(1534): Ceres cDNA ID no. 22005579
  misc_feature (1)..(1534): Ceres CLONE  ID no. 686527
  misc_feature (1)..(1534): Also known as  Ceres CDNA ID no. 23475599
cattccagtccaggacggcagcaggaaagggaagaaccaatcaaccgattccccctccccactccaccccgcgccgcagcgagagcgaactggtgcctgccttccactgccggccgcgtcgtcgtcgtcccttccttccctcaatccctccctcccgctgcgctcccgtccgagactgtgaacatgtcagatagtgcattgcaagatctcaacgctgcccaatcagttgtgctcgagaaaagcaaagacagttctgtggaaccctgcagttctaagcccgtgttaaacgggaacaaatgtgtcaagaaggaaggaaatgctgtacctgatgtgaccaatggatgtgatgctgtagttgtagatatcgagtatattgattctgagaatctcacagatcttccagatgttgacacaagcctgagtactttgcttgcaaggttggattcaaaggattggatcaagacatgtgaagctcttaataatgttcgtcagttggcgatatatcacaagcaaaggttgcaggagctgctggagcctctagttcctcttattgtgaaatctgttaagaatccaaggagtgctctatgcaaaaccgcacttatgacctgcgctgacatctttaaggcatacggtgaacaaatggtcgacttgattgatcagctgctaatgccgctatttctgaaatcttcacaagacaagcgctttgtttgtgaagcagctgaggcagcccttatgtcaatgacaagctggatctccccctctatattgttaccaaaaatgcagccctacctcaaaaacaggaatccacgaattcgagcaaaagcatctgtttgtttcagtaagagtgtaccacgccttggtctggagggaatcaaagaatacggaatggacaagctcattcaggtcgcagcaacccagctcagcgaccagcttcctgaatcaagggaggctgctcgtaacctttcattggagcttcaagcattctatgagaagtctcaagcctctggtttaggcgaagatgacagcgcacctgctatttcaccagaagctgaaacctgggaggctttctgcctatctaagctttctgctttaagcgcccaagcaatcctccgtgtcactgtgggtgtccctgttgccccaaaagaaggcggcatctctgctgctctgaaagaaggcggcatccctgctgccctgaaagaaggtggcatctctgttgtcgttgctccaaaagaaggtggcgcccctgttgctacgaaagaaggtgctgcggccgtgggctgctagcgttgggagttggccgacacaagcgatgttgcgatttttccacatccaattcacgtttttgctgtacatgatttatgggttgctcggtcggtaaatcgaatctccttttgctggagttcttcaggcttgagggcctggggtgggtgttaatattggtgcgagatatagtcccttatagttgactgtataatcctttggttccgtcactacttatcagtttggcattgattggccaaaaaaaaaaaaaaaa

SEQ ID NO: 5122 - protein, 366 aa, Triticum aestivum
  misc_feature: PFam Name: HEAT; PFam Description: HEAT repeat
  misc_feature: PFam Name: Keratin_B2; PFam Description: Keratin, high
  misc_feature: GI Number: 51979208; NR Description: PREDICTED P0543C11.17-3 gene product [Oryza sativa (japonica cultivar-group)] >gi|51979206|ref|XP_507469.1| PREDICTED P0543C11.17-3 gene product [Oryza sativa (japonica cultivar-group)] [Oryza sativa
  misc_feature: GI Number: 51979707; NR Description: PREDICTED P0702C09.23 gene product [Oryza sativa (japonica cultivar-group)] >gi|51979705|ref|XP_507599.1| PREDICTED P0702C09.23 gene product [Oryza sativa (japonica cultivar-group)] [Oryza sativa (japonica
  misc_feature: GI Number: 21537265; NR Description: unknown [Arabidopsis thaliana]
  misc_feature: GI Number: 21593517; NR Description: unknown [Arabidopsis thaliana]
  misc_feature: GI Number: 50510481; NR Description: mKIAA0423 protein [Mus
MSDSALQDLNAAQSVVLEKSKDSSVEPCSSKPVLNGNKCVKKEGNAVPDVTNGCDAVVVDIEYIDSENLTDLPDVDTSLSTLLARLDSKDWIKTCEALNNVRQLAIYHKQRLQELLEPLVPLIVKSVKNPRSALCKTALMTCADIFKAYGEQMVDLIDQLLMPLFLKSSQDKRFVCEAAEAALMSMTSWISPSILLPKMQPYLKNRNPRIRAKASVCFSKSVPRLGLEGIKEYGMDKLIQVAATQLSDQLPESREAARNLSLELQAFYEKSQASGLGEDDSAPAISPEAETWEAFCLSKLSALSAQAILRVTVGVPVAPKEGGISAALKEGGIPAALKEGGISVVVAPKEGGAPVATKEGAAAVGC

SEQ ID NO: 5123 - DNA, 1220 bp, Zea mays
  misc_feature (1)..(1220): Ceres cDNA ID no. 22005581
  misc_feature (1)..(1220): Ceres CLONE  ID no. 688596
  misc_feature (1)..(1220): Also known as  Ceres CDNA ID no. 23820810
actgctcagcagtcagtcagcactcgccacccacacgcctccgctccgcccacgggtccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggggccaactgttgaatttattcctggcagacgtgattcgtcggtgtgcccccgtgaagggcgtctgccagatgctaagaaaggtgcaccacatctgagggacatcttttatcggatgggcttatcggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagctcccaactgacaaggcactgttatcagatcctgaatttaggcgctatgtggagctctatgcaaaggatgaagatgcgttcttcaaagattatgctgaatcacacaagaaactctctgagcttggcttcacgcctcgcagcacagcaccatccaaatcagatcttccaaccgccgccgtgcttgcacagagtgcctttggggtagcagttgctgcagccgtagttatcgctggctacttgtacgaggcttccaagaaggccaagtagagggcgaagttcttctccacatggctttgctttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatggagatggcatagcctactattggaagtatatgcattctgtgtaatccaaaaaaaaaaaaaaaaaa

SEQ ID NO: 5124 - protein, 289 aa, Zea mays
  misc_feature: PFam Name: peroxidase; PFam Description: Peroxidase
  misc_feature: GI Number: 15080682; NR Description: peroxisome type
  misc_feature: GI Number: 1019946; NR Description: ascorbate peroxidase >gi|7484726|pir||T09845 L-ascorbate peroxidase (EC 1.11.1.11),
  misc_feature: GI Number: 5442410; NR Description: ascorbate peroxidase
  misc_feature: GI Number: 21554292; NR Description: L-ascorbate peroxidase [Arabidopsis thaliana] >gi|1523791|emb|CAA66926.1| L-ascorbate peroxidase [Arabidopsis thaliana] >gi|1332439|emb|CAA66640.1| ascorbate peroxidase [Arabidopsis thaliana]
  misc_feature: GI Number: 15430584; NR Description: peroxisomal ascorbate
MAAPMVDAEYLRQVDRARRHLRALISNKGCAPIMLRLAWHDAGTYDLKTKTGGANGSIRYEEEYTHGSNAGLKIAIDLLEPIKAKNPKITYADLYQLAGVVAVEVTGGPTVEFIPGRRDSSVCPREGRLPDAKKGAPHLRDIFYRMGLSDKDIVALSGGHTLGRAHPERSGFDGAWTKEPLKFDNSYFLELLNEESEGLLKLPTDKALLSDPEFRRYVELYAKDEDAFFKDYAESHKKLSELGFTPRSTAPSKSDLPTAAVLAQSAFGVAVAAAVVIAGYLYEASKKAK

SEQ ID NO: 5125 - DNA, 758 bp, Zea mays
  misc_feature (1)..(758): Ceres cDNA ID no. 22005582
  misc_feature (1)..(758): Ceres CLONE  ID no. 688882
  misc_feature (1)..(758): Also known as  Ceres CDNA ID no. 23823098
atcgcaaacaagatctctaaccactgcattatttggctatagagagtgatcgcgatcgttgtagctgttggcttgtgatcgagacgagcaatggcgtccagggcgtttgcgctgttcctggccgtgaacctggtggtgctgggcgtagccagcgcctgctcgccctactgcccgaccccgaccccgaccccctcgacgccgacgacgcccacgcccacgccgtcgtcgttcggcaggtgcccccgcgacgcgctcaagcttggcgtgtgcgccaacgtgctgggcctcatcaaggcgaaggtgggcgtgccgcccgcggagccgtgctgcccgctgctggaggggctcgtcgacctggaggccgccgtctgcctctgcaccgccatcaagggccaaatcctcggcatcaacctcaacctgccaatcgatctcagcctcatcctcaactactgcggcaggaccgtgcccaccggcttcaagtgctgagctgagcgcgcctagagctcagcgccttgcgtgctcgacgtgctgcgttcgcctcccttgcatgcatattatggtttggttgcatttccacgtccgtgcggtcgtttggatctgatttgtattctccccgcctggctgctgcctctttatttgctccccgtgcatttgtcatgttgtaaagagttagccggctgtcacttgtatgccggtgatacataagttccaatcaagtttgtcttgcgctttatatttcgaaaaaaaaaaaaaaaaaa

SEQ ID NO: 5126 - protein, 131 aa, Zea mays
  misc_feature: PFam Name: Tryp_alpha_amyl; PFam Description: Protease
  misc_feature: GI Number: 50911525; NR Description: root-specific protein RCc3 [Oryza sativa (japonica cultivar-group)] >gi|1084461|pir||S53012 root-specific protein RCc3 - rice >gi|786132|gb|AAA65513.1| RCc3 >gi|49388506|dbj|BAD25630.1| sativa
  misc_feature: GI Number: 39748094; NR Description: lipid transfer protein-like protein [Oryza sativa (japonica cultivar-group)] >gi|38345484|emb|CAE01698.2| OSJNBa0010H02.22 [Oryza sativa (japonica cultivar-group)] >gi|50927841|ref|XP_473448.1|
  misc_feature: GI Number: 37536718; NR Description: putative lipid transfer protein [Oryza sativa (japonica cultivar-group)] >gi|10140658|gb|AAG13494.1| putative lipid transfer protein [Oryza sativa (japonica cultivar-group)]
  misc_feature: GI Number: 39748092; NR Description: lipid transfer
  misc_feature: GI Number: 37536722; NR Description: putative lipid transfer protein [Oryza sativa (japonica cultivar-group)] >gi|10140651|gb|AAG13487.1| putative lipid transfer protein [Oryza sativa (japonica cultivar-group)]
MASRAFALFLAVNLVVLGVASACSPYCPTPTPTPSTPTTPTPTPSSFGRCPRDALKLGVCANVLGLIKAKVGVPPAEPCCPLLEGLVDLEAAVCLCTAIKGQILGINLNLPIDLSLILNYCGRTVPTGFKC

SEQ ID NO: 5127 - DNA, 1206 bp, Triticum aestivum
  misc_feature (1)..(1206): Ceres cDNA ID no. 22005585
  misc_feature (1)..(1206): Ceres CLONE  ID no. 697163
  misc_feature (1)..(1206): Also known as  Ceres CDNA ID no. 24410030
agctagcgttcatccatcagaacgacatcattcgagcgacatcgtctccatagccacaagtacacaagaaactacgtacggttgttcagaggaaaccgactggtggtaggccatggccggagcctacgtgcgcacggcgatcatgctcgcgctcggctgcgcgctggccatcgccgcagacgctctggagccgagcgggtgggtgagggcgcatgccaccttctacggcggcagcgacgcctccggcaccatgggcggtgcgtgcgggtacgggaacctgtacgcgcaggggtacggcacgcggacgacggcgctgagcacggcgctcttcagcgacggcggcgcgtgcgggcagtgctacaaggtggtgtgcgaccgcaagacggacaagacgtggtgcaagcccggcgtgtccgtcaccgtcaccgccaccaacttctgcccgcccaactgggacctccccagcgacaagggcggctggtgcaacccgccgcgcccccacttcgacatggcgcagcccgcctgggagaagatcggcgtctaccgcggcggcatcatccccatcatctaccaaagggtgccgtgcgtgaagaagggcggagtgcggttcaccatcagcggccacgactacttcgagctggtgctgccgaccaacgtggcggccgccggctccatcagggccatggacgtcaggggctccaagtccggcgactggatggccatggcgcacaactggggcgccaactggcactccctcgcctacctcaacggccaggggctctccttcagggtcaccatcaccgacggccagacgctcgtcttctccgatgtggtgccgcccagctggaggttcggccagaccttctccagtaacctgcagttcaagtgaccgagaaacgttgacgacgtacggcgtacgtacgtgaagatgaactcaattaggcatccaatttatttgctatacaacttgggtgtaatgggtggtcgatttacttagtaacctacagttcaagtgatcgagaaatcgttgacgacgtgcagatgaagttgcttagatatctaatttgtttgctatatactctatatgatgtagtaacaacttgagtgtaatgtgtggttgattttcgggcgatatgtgagcaatggagaaggggttaatccggttcaaaacaaaaaaaaaaaaaaaaaaaaaaaaaaaaaaaaaaa

SEQ ID NO: 5128 - protein, 258 aa, Triticum aestivum
  misc_feature: PFam Name: DPBB_1; PFam Description: Rare lipoprotein A
  misc_feature: PFam Name: Pollen_allerg_1; PFam Description: Pollen allergen
  misc_feature: PFam Name: Podocalyxin; PFam Description: Podocalyxin
  misc_feature: GI Number: 50251481; NR Description: alpha-expansin OsEXPA13 [Oryza sativa (japonica cultivar-group)] gi|16517037|gb|AAL24485.1|
  misc_feature: GI Number: 50251490; NR Description: alpha-expansin OsEXPA23 [Oryza sativa (japonica cultivar-group)] gi|50251487|dbj|BAD28626.1| alpha-expansin OsEXPA23 [Oryza sativa (japonica cultivar-group)] gi|16517056|gb|AAL24494.1|
  misc_feature: GI Number: 50251485; NR Description: alpha-expansin OsEXPA14 [Oryza sativa (japonica cultivar-group)] gi|16517039|gb|AAL24486.1|
  misc_feature: GI Number: 18855018; NR Description: putative alpha-expansin
  misc_feature: GI Number: 50251486; NR Description: alpha-expansin OsEXPA24
MAGAYVRTAIMLALGCALAIAADALEPSGWVRAHATFYGGSDASGTMGGACGYGNLYAQGYGTRTTALSTALFSDGGACGQCYKVVCDRKTDKTWCKPGVSVTVTATNFCPPNWDLPSDKGGWCNPPRPHFDMAQPAWEKIGVYRGGIIPIIYQRVPCVKKGGVRFTISGHDYFELVLPTNVAAAGSIRAMDVRGSKSGDWMAMAHNWGANWHSLAYLNGQGLSFRVTITDGQTLVFSDVVPPSWRFGQTFSSNLQFK

SEQ ID NO: 5129 - DNA, 689 bp, Zea mays
  misc_feature (1)..(689): Ceres cDNA ID no. 22005587
  misc_feature (1)..(689): Ceres CLONE  ID no. 701457
  misc_feature (1)..(689): Also known as  Ceres CDNA ID no. 22005587
aaaaaacttacccttcttctctctgtgtgtgtgcgcatcaaacgcaaccagaagcagccatggccactgcaagaactgtgaaggacgtttctcctcatgagttcgtcaaagcttactcttctcacctcaagcgatctggcaagatggagctgccagagtggactgatattgtgaaaactgcaagatttaaggagttggctccttatgatcctgactggtactatgtcagagctgcttccatggcaagaaagatctacttgagaggaggacttggtgttggtgcctttcagaggatttatggtgggagcaagaggaatggtagccgccctcctcatttctgcaagagcagtggtgctgttgctcgtcacattcttcaacagttgcagaacatgagcatcattgaactggacaccaagggtggcaggaaaatcacttccagtggccggcgggatcttgatcaagtggctggacgcattgtggttgcaccttgatttgaaaacgccataagcatattgaggtttttggtttctggttagagagatgtgatgataacagattatgctaaagttttgattttagactgtcttttatgtatcggacatgctcaatgtttatgttgctcccagtcctttttagatagtattgctatatttaattgagtttttttccccggaaaaaaaaaaaaaaaa

SEQ ID NO: 5130 - protein, 143 aa, Zea mays
MATARTVKDVSPHEFVKAYSSHLKRSGKMELPEWTDIVKTARFKELAPYDPDWYYVRAASMARKIYLRGGLGVGAFQRIYGGSKRNGSRPPHFCKSSGAVARHILQQLQNMSIIELDTKGGRKITSSGRRDLDQVAGRIVVAP

SEQ ID NO: 5131 - DNA, 1058 bp, Zea mays
  misc_feature (1)..(1058): Ceres cDNA ID no. 22005590
  misc_feature (1)..(1058): Ceres CLONE  ID no. 702174
  misc_feature (1)..(1058): Also known as  Ceres CDNA ID no. 0
gagaatgtcgaaggaagtgagccagcagaggaaggactacgtagaccctccgccagcccccctcatcgacttggccgagattaagctctggtccttctacagagccctcatcgccgagtttatcgccacactcctcttcctctacgtcaccgtcgccaccgtcattggccacaaaaaacagaccggaccatgtgacggcgttggccttctcggcatcgcatgggccttcggtggcatgatctttgtcctcgtctactgcaccgccggcatttctggtggacacatcaaccctgcggtgacttttggcctgttcctggcccgcaaggtgtctctcattcgtgccctgttctacatggtagcgcagtgtttgggtgctatctgcggtgtcgggttggtgaaggccttcatgaagcactcctacaactccctcggcggcggtgctaactccgtcagcgctggctacaacaaaggcagtgctctgggtgcggagatcatcggcactttcgtccttgtctacaccgttttctcggctaccgaccccaagagaagcgctcgtgactctcatatccccgtgttggccccattgcccattgggtttgccgttttcatggttcacttggccaccattcccatcactggtaccgggattaacccagcaaggagcttcggtgctgctgttatctacaacaatggcaaagtttgggatgaccattggatattctgggttggaccattcgtgggagcgttggcggcggcggcgtaccatcagtacatcctgagagcagcggctattaaggccttagggtcgttcaggagcaaccctaccaactagtttacttcatccatagacagaccctttattttgtgtttgcattctgtatgtgtgtatgcgtttgatgtaggagaaccatgatgatgaccaattcgtccttttctttcttttgtaatttactatttatttttttatttcttaatttgcttttgtttgtatcagagatcatcatgatcattcatgaccgttatttacattattgtttttattaaaaaaaaaaaaaaaa

SEQ ID NO: 5132 - protein, 275 aa, Zea mays
MSKEVSQQRKDYVDPPPAPLIDLAEIKLWSFYRALIAEFIATLLFLYVTVATVIGHKKQTGPCDGVGLLGIAWAFGGMIFVLVYCTAGISGGHINPAVTFGLFLARKVSLIRALFYMVAQCLGAICGVGLVKAFMKHSYNSLGGGANSVSAGYNKGSALGAEIIGTFVLVYTVFSATDPKRSARDSHIPVLAPLPIGFAVFMVHLATIPITGTGINPARSFGAAVIYNNGKVWDDHWIFWVGPFVGALAAAAYHQYILRAAAIKALGSFRSNPTN

SEQ ID NO: 5133 - DNA, 1707 bp, Triticum aestivum
  misc_feature (1)..(1707): Ceres cDNA ID no. 22005591
  misc_feature (1)..(1707): Ceres CLONE  ID no. 702762
  misc_feature (1)..(1707): Also known as  Ceres CDNA ID no. 24412814
aataaacccagcgcgtgcggtccacgactcggcggcggcgccgtgcccaggccgcgagcacgggcacacagcgcttcgagaggcctccctcccgcgactgaagatcatccctctcgggcgcaccccacgcgcgatggcggaggcgcctctgctgccgcggaaggaccaggaggcgacggggtactggcggagcgaggccaggaagctggcgtacctggcgctgccgatggtggccgtgagcctgtcgcagtacgcggtgcaggtgtcctccaacatgatggtcggccacctccccggcgtcctcccgctctcctccgctgccatcgccacctccctcgcttccgtctccggcttcagcctgctcaccggcatggcaagcgcactggaaacgctctgcggccaggcctacggcgcaaggcagtaccacactctggggctccacatgtacacagccatcgtcactctcctggtggcgtgcgtcccgctgtcgctcctgtgggcgttcatgggcaatctcctggtgctgatcgggcaggaccccctgatcgcgcacggcgccgggaggtacatcgtgtggctcatcccggggctcttcgccaacgccgtgatccagcccatcaccaagttcctgcagtcgcagagcctcatcatgccgctgctcctgtcgtccgtggtcacgctggcgctccacgtccccctgtgctgggtcatggtgttcagggccgggatggggtacaccggcgccgccctggccatcagtgtctcatactggctcaacgtggccatgctcgtggcctacattgcgatgtcgagctcctgcaaggagacgcgcacgccgccgaccatcaaggccttcaggggggtgggtgtgttcctgcgcctagctctgccctctgcgctcatgatatgtcttgagtggtggtcgtttgagctgcttattctcatgtcggggcttctgcccaaccccgagcttcaaacctcggtgctctcaatatgcctcacgagcgtcacattgctctttactataccttctggacttggagctgctggaagcacgcgagtagctaacgaattgggtgctgggaacccggaaggagctcgatcggcggtccgggtcgtgatgtcggtcgcggtgacagaggcggtggtcgtcagtggaagtcttttgctgtcacggcgcctcctgggccgtgcttacagcagcgaggaggaggtggcatctgccgtcgccgtgatggttcctctcgtctgcatcaccgtggtcaccgatggcctgcaaggggttctctcaggcgtcgctcgaggatgcggatggcagcacgtgggcgcgtacgtcaacctcggctccttctacttgctcggaatccccatggcgatgctcctcggttttgtgctcaagatgggggaaaaggggctttggattggcgtcgtctgtggatccatctcgcagaccacgcttctctccgccatcacgtttttcaccgactggcagaagatggctgacaaagctttggagagatcgctcagtgagaaggcaacggagtccgagtcgagatctctgctggaatagttagactgcaattttgtaggggacacgcatcccatcgctgtggtttctctctcaagtgacaatgtaattgtagaggaggaagaggacgtaaaccagagccactccttttatccctctttacaaaaaaaaaaaaaaaa

SEQ ID NO: 5134 - protein, 478 aa, Triticum aestivum
  misc_feature: PFam Name: MatE; PFam Description: MatE
  misc_feature: GI Number: 56784985; NR Description: MATE efflux protein-like [Oryza sativa (japonica cultivar-group)] gi|56784891|dbj|BAD82162.1| MATE efflux protein-like [Oryza sativa
  misc_feature: GI Number: 34911248; NR Description: P0445E10.22 [Oryza sativa (japonica cultivar-group)] >gi|19386680|dbj|BAB86062.1| P0445E10.22 [Oryza sativa (japonica cultivar-group)] >gi|20805025|dbj|BAB92700.1| P0478H03.16 [Oryza sativa (japonica
  misc_feature: GI Number: 50932693; NR Description: putative MATE efflux protein [Oryza sativa (japonica cultivar-group)] >gi|49328028|gb|AAT58729.1| putative MATE efflux protein [Oryza
  misc_feature: GI Number: 15218068; NR Description: MATE efflux protein
  misc_feature: GI Number: 50901110; NR Description: putative MATE efflux family protein [Oryza sativa (japonica cultivar-group)] >gi|41393247|gb|AAS01970.1| putative MATE efflux family protein
MAEAPLLPRKDQEATGYWRSEARKLAYLALPMVAVSLSQYAVQVSSNMMVGHLPGVLPLSSAAIATSLASVSGFSLLTGMASALETLCGQAYGARQYHTLGLHMYTAIVTLLVACVPLSLLWAFMGNLLVLIGQDPLIAHGAGRYIVWLIPGLFANAVIQPITKFLQSQSLIMPLLLSSVVTLALHVPLCWVMVFRAGMGYTGAALAISVSYWLNVAMLVAYIAMSSSCKETRTPPTIKAFRGVGVFLRLALPSALMICLEWWSFELLILMSGLLPNPELQTSVLSICLTSVTLLFTIPSGLGAAGSTRVANELGAGNPEGARSAVRVVMSVAVTEAVVVSGSLLLSRRLLGRAYSSEEEVASAVAVMVPLVCITVVTDGLQGVLSGVARGCGWQHVGAYVNLGSFYLLGIPMAMLLGFVLKMGEKGLWIGVVCGSISQTTLLSAITFFTDWQKMADKALERSLSEKATESESRSLLE

SEQ ID NO: 5135 - DNA, 914 bp, Glycine max
  misc_feature (1)..(914): Ceres cDNA ID no. 22005592
  misc_feature (1)..(914): Ceres CLONE  ID no. 706795
  misc_feature (1)..(914): Also known as  Ceres CDNA ID no. 24429013
accaaaggcagtagtgtgttcaccgtggaactgttcttctctctcataacatgccctctgcccaggatccattttacgttgtcaaggccgagattcaagattctattgataagctgcaatctacttttcaccaatgggaaagcaagtccggtgctgcggaacaaggacatcttacaaaggaggttcttgctggatgcgaaagcatagagtggcaggtggatgaattggataaggcaattgctatagcatctagagatccttcttggtatgggatagatgaagctgaggtcgaaagccgaaggagatggacaagtaacactcgttctcaggttggcacaatgaagaaagcagtggaatctggcaagggctcaagtaccacaagccatgctagtgttaatgggatgcgccgagaactaatgaggctaccaaattctcatcaaactgatagctctaaccagtatgctgcccgagataatgatgatttcatactatcagaatcagatagacaaacacttcttataaagagacaggatgaggaattggatgagcttagtgaaagtgtacgaagaatcggaggtgttggacttacaatacatgatgaactcactgcacaggaaaagattctagatgaacttggttccgagatggacagtacaacaaatcgtcttgattttgtccaaaaaaaagtggcgatggttatgaaaaaggctagtgcaaagggtcagatcatgatgatattgggtttgttggccctgttcatcttcctctttatcttagtattcttcacctagtcattgagatgggaccagtctctgtgctgtttgtacatgaaaagagatctaatatttttttgttcagattcaagagtaataatagacatgcatttaactattcagttaaaaaaaaaaaaaaaa

SEQ ID NO: 5136 - protein, 246 aa, Glycine max
  misc_feature: PFam Name: SNARE; PFam Description: SNARE domain
  misc_feature: GI Number: 57899182; NR Description: putative syntaxin 6
  misc_feature: GI Number: 34905840; NR Description: putative syntaxin [Oryza sativa (japonica cultivar-group)] >gi|15289935|dbj|BAB63630.1|
  misc_feature: GI Number: 6560768; NR Description: F3M18.7 [Arabidopsis thaliana]
  misc_feature: GI Number: 498040; NR Description: ORF
  misc_feature: GI Number: 62203249; NR Description: Unknown (protein for
MPSAQDPFYVVKAEIQDSIDKLQSTFHQWESKSGAAEQGHLTKEVLAGCESIEWQVDELDKAIAIASRDPSWYGIDEAEVESRRRWTSNTRSQVGTMKKAVESGKGSSTTSHASVNGMRRELMRLPNSHQTDSSNQYAARDNDDFILSESDRQTLLIKRQDEELDELSESVRRIGGVGLTIHDELTAQEKILDELGSEMDSTTNRLDFVQKKVAMVMKKASAKGQIMMILGLLALFIFLFILVFFT

SEQ ID NO: 5137 - DNA, 1085 bp, Glycine max
  misc_feature (1)..(1085): Ceres cDNA ID no. 22005593
  misc_feature (1)..(1085): Ceres CLONE  ID no. 708274
  misc_feature (1)..(1085): Also known as  Ceres CDNA ID no. 24398650
atattgaggttgcagcgaagacgaagaggaaatgaaatgagcatatcctaatccagttatccataatttcataggcataaacgagaaattgagagagaatgtctcgtatctctacactctatcttctcgcttacaactcctttcaggccattggatggacgatttccttaactaagattttgtacaatcttctcgtcactgcatccatcaaaggaacctatgcttccgccgccagcttaatctgttttctgcaatgcgctgcattcttggaagttatacacggagccattggcattgtgcccagcggggttttgcttcctcttatgcaatggggaggaaggacgcactttgtgcttgccattgttaggaaacttgatgagcttcaggaattaccttcagtttttatcacttttcttgcatggagcatgggggaggtcattagatattcacattatgctttcggttgtttgggaaattgtccttcttggatgacctatctcaggtacactgcgtttattgtgctgtatcctttgggagtgggtcctggtgaaatatgggctatgtaccaggctcttccagttataaaggagaagaatctctatgcagattccttttcaagcctcccatttagctattatgatttccttaaggtggtacttatagcttatccatttctctggttcaaactttacctgcatatgttcaagcaacgacgtacaaaactatataaacgccatgacaagaaaagggcatgaggagctttacaaaactccattcatcttggtcagtgaatggagtcattgaattgattattgaacttccgaacttgtaattttagttccacacacgaagtattttgtgaaaaaaattaataactttcggagacactcgttcaaaatttatttatttgctactattttttttttcttgacaagataagagtgccaactgccaaataatggaattgttgctttcgattatgattaagatggtagtagttagaagaaagaccgtgatttgtaatatattgtcttttatttttatttttatttggtcttaagttataaaaaaaaaaaaaaaaaaaa

SEQ ID NO: 5138 - protein, 218 aa, Glycine max
  misc_feature: PFam Name: PTPLA; PFam Description: Protein tyrosine
  misc_feature: PFam Name: Arv1; PFam Description: Arv1-like family
  misc_feature: PFam Name: Ras; PFam Description: Ras family
  misc_feature: PFam Name: Nsp1_C; PFam Description: Nsp1-like C-terminal region
  misc_feature: GI Number: 50415499; NR Description: MGC83576 protein
  misc_feature: GI Number: 50750692; NR Description: PREDICTED: similar to protein tyrosine phosphatase-like (proline instead of catalytic
  misc_feature: GI Number: 34869216; NR Description: similar to protein
  misc_feature: GI Number: 62657970; NR Description: PREDICTED: similar to protein tyrosine phosphatase-like (proline instead of catalytic
  misc_feature: GI Number: 50416334; NR Description: Ptplb-prov protein
MSRISTLYLLAYNSFQAIGWTISLTKILYNLLVTASIKGTYASAASLICFLQCAAFLEVIHGAIGIVPSGVLLPLMQWGGRTHFVLAIVRKLDELQELPSVFITFLAWSMGEVIRYSHYAFGCLGNCPSWMTYLRYTAFIVLYPLGVGPGEIWAMYQALPVIKEKNLYADSFSSLPFSYYDFLKVVLIAYPFLWFKLYLHMFKQRRTKLYKRHDKKRA

SEQ ID NO: 5139 - DNA, 1067 bp, Glycine max
  misc_feature (1)..(1067): Ceres cDNA ID no. 22005595
  misc_feature (1)..(1067): Ceres CLONE  ID no. 709596
  misc_feature (1)..(1067): Also known as  Ceres CDNA ID no. 24402883
aaaaagaagaagagagagagagagaaagagagaagagaggagggtgtgtttctggtttttggaaatttcagcccccatcgaaaaacaagaagccccaacgatagtaatcatcgaaggaatttgaaaggtcgaaacttgagcatctgggatcgcgaaattggggattttggttaaaagggtataatcttcggaactgattgatggcaaaactgtacgtgaaggcggtgccaccggcggatctgaacaggaacacggattggttcacgtaccctggcgtttggaccagttacatcctcatccttttcttttcttggatcctcgtactctctgtcttcggttgttctcctggcatcgcttggaccatcgttaatctcgcacactttgctgtaacatatgacttttttcactggaagaaaggaactccatttgcagaggaccaagggatctacaatagattgacttggtgggagcaggtagacaatggaaagcagcttactcgtaacaggaagtttctcacagttgttcctttggtgctgtacttgatagcctcacacacaacagactatcagaatccaatgttcttattcaacactgttgcagtgattgtgctggttgttgcaaagttcccccacatgcacaaggtcaggatatttagaatcaatgctgataagtgaaatgttgctgtggccatgacacttggttaccactccttacctgctcaagagcctcttcttgtccttttgttctggaaaaaaaggtcacacctttgtatagaaggcagaattggaaggatactcaagtaatgttttgttgccaactgctttttaagctgcttctaaaagtattattaaacaaataaatatgttgagttatttctgtacagtagagaagtatatgtatctgactatatcggtgcttttaaaatgtacatttcttttctagtcttttttcctttatttgatgccttagaactgtgagatatacaatgatgatcctttccgttggtattaactttttcttttggaaataatagtccttctttttgataactaaaaaaaaaaaaaaaa

SEQ ID NO: 5140 - protein, 157 aa, Glycine max
  misc_feature: PFam Name: ORMDL; PFam Description: ORMDL family
  misc_feature: GI Number: 50253201; NR Description: ORMDL family
  misc_feature: GI Number: 18419644; NR Description: unknown [Narcissus
  misc_feature: GI Number: 1842140; NR Description: similar to Saccharomyces cerevisiae ORM1 gene: EMBL Accession Number Y08687
  misc_feature: GI Number: 62859529; NR Description: LOC548829 [Xenopus tropicalis]
  misc_feature: GI Number: 61808495; NR Description: PREDICTED: similar to
MAKLYVKAVPPADLNRNTDWFTYPGVWTSYILILFFSWILVLSVFGCSPGIAWTIVNLAHFAVTYDFFHWKKGTPFAEDQGIYNRLTWWEQVDNGKQLTRNRKFLTVVPLVLYLIASHTTDYQNPMFLFNTVAVIVLVVAKFPHMHKVRIFRINADK

SEQ ID NO: 5141 - DNA, 1252 bp, Glycine max
  misc_feature (1)..(1252): Ceres cDNA ID no. 22005596
  misc_feature (1)..(1252): Ceres CLONE  ID no. 712624
  misc_feature (1)..(1252): Also known as  Ceres CDNA ID no. 25088304
aaaaaaaaaataatcagaaacgcaaatgtcaagaatcacccaattccgagctctactactccgcggcaccaccaaccagcgctcccctctccgccgccccgccgtcgccgattcttcatttgcatcaaaaccctcattctctaatgccgccgcgttccgcgcctcttcgcctgtgttccacccgcaacaacgcctcggcaatagcaccttccgattcttctcatccaatttcgacaaaggctttgcgcagaaggtatttgataaaccggccgccgcggtgacctcggccttctcgcgttaccgcgaggcaattgggctgcaaatcgaggcgttcttcaagaggaatactctctttctgtggggcgccggtggcgttgtcctctgcgcttttctgtggaggatccttttcgggatcgctagcctcttcgttggactctccgaaggcatggccaagtatggcttccttgccctttcatctgctatcgttgcttttactggcttgtatatccgtgcgaggctcacgatcaacccggataaagcctatagaatggccatgacgaaacttaacacgtcggctgggattcttgaagttatgggtgcccctctttctggaactgatttgagagcctatgtcatgtcagggggtgggctcactgtaaagaagttcaagccaagtgttaggggccgacggtgttttctcattttccccataagagggtctgagaaaaagggtctagtcagtgttgaagtcaagaaaaagaagggccagtatcatatgaagctgctggctgttgatgttcccatggcttctggtccagaccagcggttgtatctaattgggaatgaagaagagtacagggtcggtggggggataatatctgagctaagagaccctgtagtgagagcaatggcagcaaccaaggaatttgatgatcttgatgagattgaggaagaggaagatgctgaaagagaacggcaagaggctgaaagaaaggagcatgaagagattgaaaagcttgaaaagagtagtggcacctagtggatagactttctttcgtgatgtttctcttgtgatttattctcttgttgattacaggaggttgatgttgtttaaacacattttgttttgtatcagttcgagttttccctagatttagaaacccttgtaccacaaatgaccaagtttatctgaaaataaagctgacagggatcaacgtgcattggaatggactcggcaaaaaaaaaaaaaaaa

SEQ ID NO: 5142 - protein, 337 aa, Glycine max
MSRITQFRALLLRGTTNQRSPLRRPAVADSSFASKPSFSNAAAFRASSPVFHPQQRLGNSTFRFFSSNFDKGFAQKVFDKPAAAVTSAFSRYREAIGLQIEAFFKRNTLFLWGAGGVVLCAFLWRILFGIASLFVGLSEGMAKYGFLALSSAIVAFTGLYIRARLTINPDKAYRMAMTKLNTSAGILEVMGAPLSGTDLRAYVMSGGGLTVKKFKPSVRGRRCFLIFPIRGSEKKGLVSVEVKKKKGQYHMKLLAVDVPMASGPDQRLYLIGNEEEYRVGGGIISELRDPVVRAMAATKEFDDLDEIEEEEDAERERQEAERKEHEEIEKLEKSSGT

SEQ ID NO: 5143 - DNA, 2032 bp, Glycine max
  misc_feature (1)..(2032): Ceres cDNA ID no. 22005597
  misc_feature (1)..(2032): Ceres CLONE  ID no. 713858
  misc_feature (1)..(2032): Also known as  Ceres CDNA ID no. 24402872
gcgttctttccattttcatactcattccactcattttctttctgcttcgtcgttcacttcagaatccaaaaacagtctaaaaaagaataataataaacagcgaagttaccaagattctgttgagaagaagagcaatgccgtccaacgattccgattcgccgatgaagatcgtacatggcgacgctggttacatactcgaagacgttcctcacttcaccgactacattccaaatcttcctacgtatccgaatccgcttcgatccaatcctgcttactcggttgttaagcagtatttcgtgcacatggacgacactgttcctcagaaggttgttgttcacaaggatagtccaagaggtatacattttcgacgtgcagggcctcggcaaaaggtatactttaaatcggatgaagtgcatgcatgcattgtcacgtgtggtggactctgccctggcctcaacactgtcataagggaaattgtctgtggtctttcctacatgtacggtgttaacaaagtccttggcatagatggtggttatagaggcttttattccaaaaacaccattactttaacacctaaggtggtcaatgacatccataagcgtgggggtacaattcttgggacatcccgaggggggcatgatacgggcaagatagttgacagcatccaggatcgaggaattaatcaggtttatattattggaggagatggaacacagagaggagcgactgtgatttacgaggaagttagacggcggggtctgaaagtagcaattgctggaattcctaaaaccatagacaatgacatcccggttattgacaaatcttttggttttgatactgcggttgaggaggctcaacgtgccattaatgcagctcatgttgaagctgaaagtattgagaatggtattggtgttgtaaagctaatggggcgttatagtggttttattgcaatgtatgccactcttgctagcagagacgtggactgttgcttgattccagagtcgcccttctaccttgaaggaaagggtggactttttgaatttattcagaaaaggctgaaagaaaatggacatatggtcatagtcatagctgagggagcaggacaagatcttcttacagaaagcatgcaagccatggatcagaaggatgcttctggaaacaaactacttcaagatgttggtttatggatatctcataagatcaaggatcactttgcaaggaaggataagattcccatcaatcttaaatatatagatccaacttacatgatccgggcaatccaaagcaatgcatcagataatgtctactgtacacttcttgctcagagtgcagtccatggtgcaatggcagggtatactggatttacagttggactggtcaacggcagacatacttatattccattcaatagaatcaatgagaggcagaacaaggttgtgattactgacagaatgtgggcaagactcctttcttcaaccaaccagcctagctttttgagccccaaagatttagaagaagccaagaaagcagaacaacctccgactgaattgttggaaggaaacaattgcaatgatgttggtgatgccgggaaagaagaacaacctcccaaagatgaacaagaatcaggaaatcacgcagacaatggtatcaagacagaaaattagatttagacttgttcatctacaagactacaattgtatttggtgacatgttttatcattttgactcaagccctacaaccttcaaagcctggagtgttgggagctgttctttttgtccttttaatgttttgcaagttggtacgtctttctttataaagacctaccgtcttgcgtgattgttgttgtactcagaagattgttgaatgttaacctaggtcatattaagattggaacggaattatttgacgtgcttgaaggtactgtatctggttattgttgttctgtgttttggtagtgacttgagtttttatacgcagttttgctggaacgaggtataaataaacaattttctagtaaaaaaaaaaaaaaaa

SEQ ID NO: 5144 - protein, 509 aa, Glycine max
  misc_feature: PFam Name: PFK; PFam Description: Phosphofructokinase
  misc_feature: GI Number: 19699124; NR Description: AT4g26270/T25K17_80 [Arabidopsis thaliana] >gi|15146208|gb|AAK83587.1| AT4g26270/T25K17_80 [Arabidopsis thaliana] >gi|18416717|ref|NP_567742.1| phosphofructokinase family protein
  misc_feature: GI Number: 53749196; NR Description: At4g29220 [Arabidopsis thaliana] >gi|7269820|emb|CAB79680.1| pyrophosphate-dependent phosphofructo-1-kinase-like protein [Arabidopsis thaliana] >gi|15233495|ref|NP_194651.1| phosphofructokinase family protein
  misc_feature: GI Number: 29029114; NR Description: At4g32840 [Arabidopsis thaliana] >gi|7270231|emb|CAB80001.1| putative pyrophosphate--fructose-6-phosphate 1-phosphotransferase [Arabidopsis thaliana] >gi|15233959|ref|NP_195010.1|
  misc_feature: GI Number: 21593599; NR Description: putative pyrophosphate--fructose-6-phosphate 1-phosphotransferase
  misc_feature: GI Number: 34909350; NR Description: putative pyrophosphate--fructose-6-phosphate1 phosphotransferase [Oryza sativa (japonica cultivar-group)] >gi|14090340|dbj|BAB55499.1| putatative pyrophosphate--fructose-6-phosphate1
MPSNDSDSPMKIVHGDAGYILEDVPHFTDYIPNLPTYPNPLRSNPAYSVVKQYFVHMDDTVPQKVVVHKDSPRGIHFRRAGPRQKVYFKSDEVHACIVTCGGLCPGLNTVIREIVCGLSYMYGVNKVLGIDGGYRGFYSKNTITLTPKVVNDIHKRGGTILGTSRGGHDTGKIVDSIQDRGINQVYIIGGDGTQRGATVIYEEVRRRGLKVAIAGIPKTIDNDIPVIDKSFGFDTAVEEAQRAINAAHVEAESIENGIGVVKLMGRYSGFIAMYATLASRDVDCCLIPESPFYLEGKGGLFEFIQKRLKENGHMVIVIAEGAGQDLLTESMQAMDQKDASGNKLLQDVGLWISHKIKDHFARKDKIPINLKYIDPTYMIRAIQSNASDNVYCTLLAQSAVHGAMAGYTGFTVGLVNGRHTYIPFNRINERQNKVVITDRMWARLLSSTNQPSFLSPKDLEEAKKAEQPPTELLEGNNCNDVGDAGKEEQPPKDEQESGNHADNGIKTEN

SEQ ID NO: 5145 - DNA, 995 bp, Glycine max
  misc_feature (1)..(995): Ceres cDNA ID no. 22005598
  misc_feature (1)..(995): Ceres CLONE  ID no. 715530
  misc_feature (1)..(995): Also known as  Ceres CDNA ID no. 24403063
aaaaatcacatcacacacaaacacacacacggtcttcttttatcctttctctcattctttcatgttccaaactaaaatggcaactaactctctccattactccatccaacaccaccaccattccctcaccaaacgccatcacccttcagacaccccaccccacacatcacttttcctcaaacaccctacaccccctatacaccccaacatcactatctcccacactccttcaaactcacacatcacttactccctctctcaaaccacctcttcctccaccacctccccaaccaccccttcctttgacctcctccgccaccacctctccaacaaaaacttcgaattggccgatgaggagacgcgccgtctccttatcgtcctagctggcgaagccgcgcagaagcgtggctacgtctttttctcggaggtgaagttcatctctgagggtggcctgcgggccatagactccctctggagggagtacagtggcgggaaattcgggtacagcgtgcagaagaagctactggagaaggccaatggggacttcaccaagttcttcatcaaggttgggtggatgaagaagcttgacactgagatggagcaatacaactacaggtccttccccactgagttcatctgggagctcaatgatgacaccccagaggggcatttgcctctcacaaacgctctcagagggacacagttgctcaacaacgttctcaaacacccagcttttgatgtagttgatgacaaagaagaaaaagaaaaagatggtgagaacaaggaaaatggaggagcaatctctgccacaggattaaaggataatggttcttcttcaaagaggatcttcaaaacggactatagcttctgagtgcatagaggaatggatgtactttaatttggaggttaaattttacgtataagataaacatatagtagttattagtattaatttattatcaaacagtgcaactgtgcaaaaaaaaaaaaaaaaa

SEQ ID NO: 5146 - protein, 995 aa, Glycine max
  misc_feature: PFam Name: GUN4; PFam Description: GUN4-like
  misc_feature: GI Number: 62734221; NR Description: GUN4, putative [Oryza
  misc_feature: GI Number: 32816239; NR Description: GUN4 mutant [Arabidopsis
  misc_feature: GI Number: 51209857; NR Description: conserved hypothetical plastid protein [Gracilaria tenuistipitata var. liui] >gi|50657611|gb|AAT79596.1| conserved hypothetical plastid protein
  misc_feature: GI Number: 46130157; NR Description: COG1164:
  misc_feature: GI Number: 48894587; NR Description: COG0265: Trypsin-like serine proteases, typically periplasmic, contain C-terminal PDZ
AAAAATCACATCACACACAAACACACACACGGTCTTCTTTTATCCTTTCTCTCATTCTTTCATGTTCCAAACTAAAATGGCAACTAACTCTCTCCATTACTCCATCCAACACCACCACCATTCCCTCACCAAACGCCATCACCCTTCAGACACCCCACCCCACACATCACTTTTCCTCAAACACCCTACACCCCCTATACACCCCAACATCACTATCTCCCACACTCCTTCAAACTCACACATCACTTACTCCCTCTCTCAAACCACCTCTTCCTCCACCACCTCCCCAACCACCCCTTCCTTTGACCTCCTCCGCCACCACCTCTCCAACAAAAACTTCGAATTGGCCGATGAGGAGACGCGCCGTCTCCTTATCGTCCTAGCTGGCGAAGCCGCGCAGAAGCGTGGCTACGTCTTTTTCTCGGAGGTGAAGTTCATCTCTGAGGGTGGCCTGCGGGCCATAGACTCCCTCTGGAGGGAGTACAGTGGCGGGAAATTCGGGTACAGCGTGCAGAAGAAGCTACTGGAGAAGGCCAATGGGGACTTCACCAAGTTCTTCATCAAGGTTGGGTGGATGAAGAAGCTTGACACTGAGATGGAGCAATACAACTACAGGTCCTTCCCCACTGAGTTCATCTGGGAGCTCAATGATGACACCCCAGAGGGGCATTTGCCTCTCACAAACGCTCTCAGAGGGACACAGTTGCTCAACAACGTTCTCAAACACCCAGCTTTTGATGTAGTTGATGACAAAGAAGAAAAAGAAAAAGATGGTGAGAACAAGGAAAATGGAGGAGCAATCTCTGCCACAGGATTAAAGGATAATGGTTCTTCTTCAAAGAGGATCTTCAAAACGGACTATAGCTTCTGAGTGCATAGAGGAATGGATGTACTTTAATTTGGAGGTTAAATTTTACGTATAAGATAAACATATAGTAGTTATTAGTATTAATTTATTATCAAACAGTGCAACTGTGCAAAAAAAAAAAAAAAAA

SEQ ID NO: 5147 - DNA, 1477 bp, Glycine max
  misc_feature (1)..(1477): Ceres cDNA ID no. 22005600
  misc_feature (1)..(1477): Ceres CLONE  ID no. 722052
  misc_feature (1)..(1477): Also known as  Ceres CDNA ID no. 24365726
atccaaaatcccctgtttcaccccctctctgttttttctcctctgttctctataaagaaaaacagaatggacaagtgggacaataaaccctcaagaaaacagcaccacagagaaaacccttcattctcttccactcttcttgacgttatctaccgttccatcgacgaagatccaacggaggagaaggaagaagcccaactcatcttctacagagaaaccatgaggaagcagaaacagggcaattgtttcagagaagaaaaacccgaagctgagaagcacaactctcgcagggccaggaaggtggagaattggatggagaagagagccagcgagaaggttctcatggggagaaactcactgacggaatttgaaagaagaacgcgaagcaattcaatttcaaacacactctccatgtattcaagctcaacctcctctgagtctagctctgttggagggttctcttcttcagagtcagagtccttctattatggagtgcaaaggccaaagccaattaaaaccagtgtttctgataaaaccaaaaccaaaaccaacttcgatgcttcactccacagtcacaacttcaggagccactcttcccaaagccaaaagccaaagcatgagaacggttttggcaaaaccaagtccaaagccttgaaaatcctctatggtgagttgaagaaagcaaagcaaccaatttcacctggtgcaaaacttgctagcttcctcaactctctcttcacttcaactggaaatgccaagaaagcaaaggtttcaacaacaacaacatctacttatcgtcccgtcctgatcccgattgcgacagatcgtgttgctgatactaaatcagtatcagcagcacaacaacaacctggttccacttgttcatcagcatcttctttttcaaggtcttgtttgagcaaaaccccttcttcaagatcaggtgcaaaaaggtctgtgaggttttgtcctgtgagtgtgatagtggatgaagattgcaggccttgtggtcacaagaatcttcatgaaggtgaagagagtttggtggattcccgtggaaagaacagaagtgaggaacttaggctgcatgtcatgcaggagagtcgcagggtggaggagttagcaagagacttgttgaagaattatcagaaaaagagtgaagtggagtttgatgatgtcatgcattatgaagatgaagaagaagaagatgatgatgatgtggctagttgtgcaagttctgatctttttgagttggataatctatcagctattgggattgagaggtatagggaagagttgcctgtgtacgaaactacccatttcaataccaatagagccattgccaatggtttcattctgtaattttgaggggggcaaaagcggggttactttttaattagaattaaatggtgtcggggtttacatcagataataagatttctccttttttttttttttggtctaaaaaaaaaaaaaaaaa

SEQ ID NO: 5148 - protein, 430 aa, Glycine max
  misc_feature: GI Number: 21593193; NR Description: putative serine rich
  misc_feature: GI Number: 16323506; NR Description: putative serine rich protein [Arabidopsis thaliana] >gi|13877841|gb|AAK43998.1| putative serine rich protein [Arabidopsis thaliana] >gi|7573372|emb|CAB87678.1| putative serine rich protein
MDKWDNKPSRKQHHRENPSFSSTLLDVIYRSIDEDPTEEKEEAQLIFYRETMRKQKQGNCFREEKPEAEKHNSRRARKVENWMEKRASEKVLMGRNSLTEFERRTRSNSISNTLSMYSSSTSSESSSVGGFSSSESESFYYGVQRPKPIKTSVSDKTKTKTNFDASLHSHNFRSHSSQSQKPKHENGFGKTKSKALKILYGELKKAKQPISPGAKLASFLNSLFTSTGNAKKAKVSTTTTSTYRPVLIPIATDRVADTKSVSAAQQQPGSTCSSASSFSRSCLSKTPSSRSGAKRSVRFCPVSVIVDEDCRPCGHKNLHEGEESLVDSRGKNRSEELRLHVMQESRRVEELARDLLKNYQKKSEVEFDDVMHYEDEEEEDDDDVASCASSDLFELDNLSAIGIERYREELPVYETTHFNTNRAIANGFIL

SEQ ID NO: 5149 - DNA, 1514 bp, Glycine max
  misc_feature (1)..(1514): Ceres cDNA ID no. 22005601
  misc_feature (1)..(1514): Ceres CLONE  ID no. 722433
  misc_feature (1)..(1514): Also known as  Ceres CDNA ID no. 24398661
attaaatttaatatacaagctctcacggtcaaacactactctgcaccaatccatggcatccatcatctctttcacccttaagacccttctattcctctgcttctgttcctttcacttcccactctcaacttcatcagaatcaaatccttcattccccaaagaagccctccccaacaaacatggttaccttccaataagccccacttcaacttcttccattttctacgctttctatgaagcccagaactcaactttaccactctcacaaaccccacttctcatatggctccaaggtggccctggctgctcctccatgattggaaacttgtacgaacttggaccgtggcgcgtcacggaatcactcacccttcaacccaaccctggtgcttggaatagaatctttggccttctttttcttgatagtcccattggaactggcttcagtgtggcctcaacgagacaagaaattccaactgatcaaaacggcgttgcaaaacacctttttgctgctataacaagctttcttcagcttgatcctgttttcaagaatcgccctatttatattactggtgaaagctatgctgggaagtatgtgcctgctattgggtattacatattggagaaaaatgcaaacttgaaggtttctgaaagagtgaatttggctggtgtgactattggggatggcttaactgaccctaaaactcaagtggctactcatgctctgaatgcttattatgttggattgatcaatgagaggcaaaagcatgagttggagaacgctcaattggaagcggttcggttgactcaaatgaggaattggagtgaagcaactgatgcaagaaacaaagtcttgagaatgttgcaaaacatgacagggttggctactttgtatgactatacaaggaaggctccttatgaggatgatttggttgaaaaattcttgaacattgctgaggtgaagaaggccttgggggtgaatgaatcgtttgtgtatgagatatgcagcgatgttgttggggctgcattgcatgctgatgtgatgaagagtgtgaaatatatggtggattacttggtgagaaggagcaaggtgttgttatatcaagggcaacatgatttgagggatggtgtggttcaaacagaggtttgggtgaagacaatgaagtgggaagggattgtggagtttgtgaatgctgaaaggaagatatggacagttaatggagagcttgcagggtatgttcaaaattggaagtctctcaccaatgttgtggttttgggtgctgggcatcttttgcctactgatcaacctcttaattctcaagcaatgatagaagattgggttttggaaaggggagtgtttgaaaatgcgcataagagacatgtatcaagtgagtctgtatttgttttgtaaggccgagattaatcattggttaaatgaaatttgttagtgtaaagctgtattcatggttaaggaatcgatgtgaaacttgtattgttaaacaaaaaaaaaaaaaaaa

SEQ ID NO: 5150 - protein, 451 aa, Glycine max
  misc_feature: PFam Name: Peptidase_S10; PFam Description: Serine
  misc_feature: GI Number: 50932851; NR Description: putative serine carboxypeptidase [Oryza sativa (japonica cultivar-group)] >gi|42491389|gb|AAS16895.1| putative serine carboxypeptidase, PF00450 [Oryza sativa (japonica cultivar-group)] sativa (japonica
  misc_feature: GI Number: 50932849; NR Description: putative serine carboxypeptidase [Oryza sativa (japonica cultivar-group)] >gi|42491390|gb|AAS16896.1| putative serine carboxypeptidase, PF00450 [Oryza sativa (japonica cultivar-group)] sativa (japonica
  misc_feature: GI Number: 50932847; NR Description: putative serine carboxypeptidase [Oryza sativa (japonica cultivar-group)] >gi|42491391|gb|AAS16897.1| putative serine carboxypeptidase, PF00450 [Oryza sativa (japonica cultivar-group)] sativa (japonica
  misc_feature: GI Number: 50901936; NR Description: carboxypeptidase precursor-like protein [Oryza sativa (japonica cultivar-group)] >gi|11761136|dbj|BAB19126.1| carboxypeptidase precursor-like protein [Oryza sativa (japonica cultivar-group)] protein [Oryza
  misc_feature: GI Number: 62857515; NR Description: CPVL [Xenopus tropicalis]
MASIISFTLKTLLFLCFCSFHFPLSTSSESNPSFPKEALPNKHGYLPISPTSTSSIFYAFYEAQNSTLPLSQTPLLIWLQGGPGCSSMIGNLYELGPWRVTESLTLQPNPGAWNRIFGLLFLDSPIGTGFSVASTRQEIPTDQNGVAKHLFAAITSFLQLDPVFKNRPIYITGESYAGKYVPAIGYYILEKNANLKVSERVNLAGVTIGDGLTDPKTQVATHALNAYYVGLINERQKHELENAQLEAVRLTQMRNWSEATDARNKVLRMLQNMTGLATLYDYTRKAPYEDDLVEKFLNIAEVKKALGVNESFVYEICSDVVGAALHADVMKSVKYMVDYLVRRSKVLLYQGQHDLRDGVVQTEVWVKTMKWEGIVEFVNAERKIWTVNGELAGYVQNWKSLTNVVVLGAGHLLPTDQPLNSQAMIEDWVLERGVFENAHKRHVSSESVFVL

SEQ ID NO: 5151 - DNA, 1876 bp, Glycine max
  misc_feature (1)..(1876): Ceres cDNA ID no. 22005602
  misc_feature (1)..(1876): Ceres CLONE  ID no. 723785
  misc_feature (1)..(1876): Also known as  Ceres CDNA ID no. 23404948
tcttccattcatttgcatctcattctgaatcttgcgccgtttccctctcccactcgccagtgttgcggaattttttagaagtgtgaatgttcgttcatgcatgagcggctcttaaagtttccttgcggattcgattgcgatatattgagactgcgatggcctcagccgtcgtgaatttcttgaacgcgacgttggattgggtgacgtttgcgtcggatggtccttctgcgcgagctgtagttttcggagtccatatcggtggacatttgtttatcgaagtgtttttgctagttgtcatacttttcttgctttcacagaaaagttacaagcctcctaaaaggcctttaacaaataaggaaattgatgagttatgtgacgaatgggttccggaaccccttattccttctcttaataaagagttgcagtatgaaccaccagtgctggagagtgctgctgggccacataccataattaatggcaaagaagttgtcaattttgcttcagcaaactatcttgggtttataggtcatccaaagctacttgactcatgttcttctgctttagcgaaatacggtgttggttcttgtggtccccgtggattttatgggacaattgatgtccaccttgactgtgaagcaagaatagcaaaatttttaggaacccctgaatcaattctgtactcttatggactttccaccatgttcagtgcaattcccgctttctctaaaaaaggagatgtaattgtggcggatgagggagtccgctggggaatacagaatggcctttatctttctagaagcacagtggtgtattttaagcacaatgacatggattctttaagagaaactctagagaacattactgccaaatataagaaggccaagaatttgaggcgttatattgttattgaagctgtctaccagaattctggggaaatagcacccttggacgagatcattaaattgaaggaaaaatatcgctttcgtgttttgctagatgagagcaactcattgggtgtgcttggaagttctggaagaggtctcactgaatactgtggagttccagttgagaagatagacattataactgcttctatgggacatgcattggccacagaaggaggattctgcactggaagtacaagagttatagatcaccaacgattgagtagctctggttatgtcttttctgcttctttgcccccatatcttgcaagtgctgcaattacagctattgatgtcctggaggaaaatcccaatctgataaaaaagctgaagaaaaatattgcttttttaagaaaaggattgtcaaaaataccaggcatcacaattacaagtaatccagagtcacctattgtttatttgagattagagaaatcaagaggttccatgaaagatgacctgcatctgcttgaaaatatcgcggaacgggttttgaaagaagaatctgtatttgtggttgtttccaaaagatcaacattggacaaatgccgtttgcctgtgggaattagattgtttgtttctgctgggcattcagagtctgatctgctcaaggcatctgaatcattgaaaaaggttgtagcatcagtcctgggtggtcagaattgaacgctctacatctttctttttcatctaatgtaccaaaacataagttcgattccatgtgtttaggtgagcaattttgaaatccaggcgatagagaaagtcccgtagttcttaatttgtgtagtattttatgttccagtttagggtaacagtattttgtgcgtgttgctcattggttgtctaaagtagtagaataaggatttaatgtttcttgtcatgagttggggaatatacctatgaattacattccgatatcaaaaaaaaaaaaaaaa

SEQ ID NO: 5152 - protein, 483 aa, Glycine max
  misc_feature: PFam Name: Aminotran_1_2; PFam Description: Aminotransferase
  misc_feature: GI Number: 15451568; NR Description: Putative serine
  misc_feature: GI Number: 23197846; NR Description: serine C-palmitoyltransferase like protein [Arabidopsis thaliana] >gi|21539529|gb|AAM53317.1| serine C-palmitoyltransferase like protein [Arabidopsis thaliana] >gi|18419845|ref|NP_568005.1|
  misc_feature: GI Number: 4006914; NR Description: serine C-palmitoyltransferase like protein [Arabidopsis thaliana] >gi|7270596|emb|CAB80314.1| serine C-palmitoyltransferase like protein [Arabidopsis thaliana] >gi|25407728|pir||F85430 serine
  misc_feature: GI Number: 2564282; NR Description: serine C-palmitoyltransferase [Mus musculus] >gi|6685592|sp|O35704|LCB1_MOUSE Serine palmitoyltransferase 1 (Long chain base biosynthesis protein 1) (LCB 1)
  misc_feature: GI Number: 2853289; NR Description: serine
MASAVVNFLNATLDWVTFASDGPSARAVVFGVHIGGHLFIEVFLLVVILFLLSQKSYKPPKRPLTNKEIDELCDEWVPEPLIPSLNKELQYEPPVLESAAGPHTIINGKEVVNFASANYLGFIGHPKLLDSCSSALAKYGVGSCGPRGFYGTIDVHLDCEARIAKFLGTPESILYSYGLSTMFSAIPAFSKKGDVIVADEGVRWGIQNGLYLSRSTVVYFKHNDMDSLRETLENITAKYKKAKNLRRYIVIEAVYQNSGEIAPLDEIIKLKEKYRFRVLLDESNSLGVLGSSGRGLTEYCGVPVEKIDIITASMGHALATEGGFCTGSTRVIDHQRLSSSGYVFSASLPPYLASAAITAIDVLEENPNLIKKLKKNIAFLRKGLSKIPGITITSNPESPIVYLRLEKSRGSMKDDLHLLENIAERVLKEESVFVVVSKRSTLDKCRLPVGIRLFVSAGHSESDLLKASESLKKVVASVLGGQN

SEQ ID NO: 5153 - DNA, 1308 bp, Triticum aestivum
  misc_feature (1)..(1308): Ceres cDNA ID no. 22005603
  misc_feature (1)..(1308): Ceres CLONE  ID no. 733968
  misc_feature (1)..(1308): Also known as  Ceres CDNA ID no. 24409576
acagaaagagagttacagacagacaccggccggcccacctcgtccgctcgtgaacgttcgttccttcgtacgccaccttacgctcctgctctccgcttcgccttcgcgcgcctccggccagctagctgccgacaacgccccggcgagtcggcgacaagctcgacagcgaccgtacgtgaagaaggtggtaccggcggcatggtcgaccaccggcaactgggtgtcgccgacgccgacctctacgccgtcctggggctcaagaaggagtgctccgacgccgacctcaggctcgcctaccggaggctcgccatgacatggcatccggaccggtgctccgcgtccggcagctcggcgcgcgtccaggaggccaaggagcggttccaggagatccagagcgcatactccgtgctctccgactccggcaagcggctcctctacgacgtcggcgtctatgacagcgacgacgaccgcctcgacgagcaacatgtgtcggggatgggcggcttcttcggggagatggccgagatgatgagccaggcaacgccaaccgatagcttcgaggagctgcagcagctgttcgtggacatgttccaggccgacctcgtcgccggcgggttcggcggtgcgccacctatgggccgccgggtccaggccccggttccgagtccatcctgtacctctggacctacgtctgcgcaggcacggccgtcctgtaacaagggtgtgaacaagcggtgttcatcggcgatgggctctgggacgccgccaagggcctgtcgcccagggtccgcctccggccccggccttgactccaagggaagtgatgggaggcgaggggaggaagggccatggacgacgacgcaggaagacgcgagcatcggcggcaggaagaagaaacagaggctgtcgacgggccacggcgtgtcgtcctaggaggaagcaagggatgcgcggcgcggccggggcggcgttgatgcgcgccgcccgtgctctctgcagatctgactgagggtcagcaagttttggaagataatgcgcaaacttttaaattagtttcttcgtttattctcttagattgattctcttggggtagcactggtagctactccctccgttcggaattacttgtcgcagaaatagatgtatctagacatattttaattctagatacatccatttccgagacaagtaattccgaacgaacagagtaagttctaatgttagacatcttcaatagatgatttagatgtaaaaataaggaaaacgattgcgcgctcagtcggctgatgatcaaaaaaaaaaaaaaaa

SEQ ID NO: 5154 - protein, 244 aa, Triticum aestivum
  misc_feature: PFam Name: DnaJ; PFam Description: DnaJ domain
  misc_feature: GI Number: 21554587; NR Description: DnaJ protein, putative
  misc_feature: GI Number: 30102878; NR Description: At1g56300 [Arabidopsis thaliana] >gi|22135874|gb|AAM91519.1| DnaJ protein, putative [Arabidopsis thaliana] >gi|18405757|ref|NP_564717.1| DNAJ heat
  misc_feature: GI Number: 23428796; NR Description: DnaJ-like protein
  misc_feature: GI Number: 34912486; NR Description: heat shock protein-like
  misc_feature: GI Number: 53793391; NR Description: heat shock-like protein [Oryza sativa (japonica cultivar-group)] >gi|53792186|dbj|BAD52819.1| heat shock-like protein [Oryza sativa
MVDHRQLGVADADLYAVLGLKKECSDADLRLAYRRLAMTWHPDRCSASGSSARVQEAKERFQEIQSAYSVLSDSGKRLLYDVGVYDSDDDRLDEQHVSGMGGFFGEMAEMMSQATPTDSFEELQQLFVDMFQADLVAGGFGGAPPMGRRVQAPVPSPSCTSGPTSAQARPSCNKGVNKRCSSAMGSGTPPRACRPGSASGPGLDSKGSDGRRGEEGPWTTTQEDASIGGRKKKQRLSTGHGVSS

SEQ ID NO: 5155 - DNA, 1696 bp, Triticum aestivum
  misc_feature (1)..(1696): Ceres cDNA ID no. 22005604
  misc_feature (1)..(1696): Ceres CLONE  ID no. 736376
  misc_feature (1)..(1696): Also known as  Ceres CDNA ID no. 24766456
agttttcaaaagaaaaaaaaacgcttgcaaccggcgaagccttcttctggaagcctccctgccactgccgacgacgagcgcgagacggcccatggcgccgccgttcgtctacgcccgcagctccgctcgggacgcggccctgcgagcggccttctacggcgacctccggcgtctcagagctactgtgaagagtcttgtagacccaagggtggtcttctctttcgacagggatggccttggtgttctgcacctcgcaaccgtcagagggcatattgaagtttgcaagtacttggtggaggaactgggaggagatgtgaatgctcctgctcctggagttggagactttgcaggcgtgacaccctttatgacatctgttcagtccgacgatgtttcaactgtgaagtatttgcttgatcgtggcgttgacctaactaaagcagatggtaaaggacgctctgttctccatcatgcagcaaccgtaggaagctgtaaggttactgagttcctactttcaaaaggagtacctgttgacatacactatggctatggtacaccactccatctagctgctaccaatgaacaagataaaatagtgaagattttgttggaacaccatgcagatgctaacaccagtgtcaccagtttgggttctgccttgatgggtgctcttttatgccgttcattgaagtgcatgaagctgctgattaagggtggtgctgatgtcaatcggatgacctcacttctgatgactccgttagtgtttactgcagggcgcaaagactataccaactttatgcaatttttgctaaaggcaggagcggatcctaatattcccgatggttttggtaggttaccaatagagcatgctgttagacgtgactgcatggaacaagttgaaatgctgtttcctttgacttccccaattccatctatcccaaactggagtatagatggaatcatctcatatgaaaaatttgaaagtgcaaagccgatggatcagaggcaccttgagcgagcaaaagctatatacaagtcacaggcagatcatgcattcaggctgaaggactataagttcgcatcaaaatcatatgatctggcaatagatgccgcaccgagtgcaacattgtacgcaaacaggagtctttgtaaactgctgttggacgatggtgaaggtgctctatcagacgctctcagctgcagaatgctgcgacctaactgggcaaaagcttgctaccgtcaggctgcagctcacatgcttctcaaagagtataagcaagcttgtgacgctctcctggacgctcaaaaattagatcctggaaacatagaggtggagagagagctacggaaagccatggaattaatgaaagctcctggtgaagctgacaagtgaagcatggtggttagcatcagagtagagcttgtgctttatgctttgttaggcagaagttcttttggcttgcattagagtagttgttcaactgaatgtgatggtacttgctgtaaaacttgctcacttatgtagaaaagagctaaatcaggcaggacgctggggtgctgaaatgtggatggggctttaccacttgagttaattacattagaagttttactgaatctagcacaaacgcgaacgatgtttcgttatgaattttgaataccttccaagttttcatactgtagtcgaaaaaaaaaaaaaaaa

SEQ ID NO: 5156 - protein, 432 aa, Triticum aestivum
  misc_feature: PFam Name: TPR_2; PFam Description: Tetratricopeptide repeat
  misc_feature: PFam Name: Ank; PFam Description: Ankyrin repeat
  misc_feature: PFam Name: TPR_1; PFam Description: Tetratricopeptide repeat
  misc_feature: GI Number: 50908589; NR Description: putative ankyrin-like protein [Oryza sativa (japonica cultivar-group)] >gi|47848270|dbj|BAD22094.1| putative ankyrin-like protein [Oryza
  misc_feature: GI Number: 34910278; NR Description: OSJNBa0089K24.26 [Oryza sativa (japonica cultivar-group)] >gi|15128240|dbj|BAB62568.1|
  misc_feature: GI Number: 55771345; NR Description: ankyrin-like protein-like [Oryza sativa (japonica cultivar-group)] gi|55771304|dbj|BAD72213.1| ankyrin-like protein-like [Oryza sativa
  misc_feature: GI Number: 50898666; NR Description: ankyrin repeat protein E4_8-like [Oryza sativa (japonica cultivar-group)] >gi|47497788|dbj|BAD19887.1| ankyrin repeat protein E4_8-like
  misc_feature: GI Number: 27542766; NR Description: ankyrin-like
MAPPFVYARSSARDAALRAAFYGDLRRLRATVKSLVDPRVVFSFDRDGLGVLHLATVRGHIEVCKYLVEELGGDVNAPAPGVGDFAGVTPFMTSVQSDDVSTVKYLLDRGVDLTKADGKGRSVLHHAATVGSCKVTEFLLSKGVPVDIHYGYGTPLHLAATNEQDKIVKILLEHHADANTSVTSLGSALMGALLCRSLKCMKLLIKGGADVNRMTSLLMTPLVFTAGRKDYTNFMQFLLKAGADPNIPDGFGRLPIEHAVRRDCMEQVEMLFPLTSPIPSIPNWSIDGIISYEKFESAKPMDQRHLERAKAIYKSQADHAFRLKDYKFASKSYDLAIDAAPSATLYANRSLCKLLLDDGEGALSDALSCRMLRPNWAKACYRQAAAHMLLKEYKQACDALLDAQKLDPGNIEVERELRKAMELMKAPGEADK

SEQ ID NO: 5157 - DNA, 1125 bp, Triticum aestivum
  misc_feature (1)..(1125): Ceres cDNA ID no. 22005606
  misc_feature (1)..(1125): Ceres CLONE  ID no. 747760
  misc_feature (1)..(1125): Also known as  Ceres CDNA ID no. 24727140
gtgtgcgtgcacccgtcgtgctcggctatcatcagtcgtcctaacgacctccgctctatcgtctactccatcttgttccatccaaatatatacctcagctcagctgtgttcacttcctgttacttcaccagcgagctaccagccaaacacccaagcaagcaagctagtgggtagcccagccccagcagagcgatcgtgatcgtgatcgatggagcccagccgccaccgtgtgccggcggcggcggcgctgctcgtgctcgtggcggtggcggccgtcgtcgggcgctgtggcgcgcagctgccgatcccggtgaggacggacgggttcctgtacggcgggaagtcggccgcgccggcgtggggcgacgcggtggtcgtcgaggccttcttcgaccccgtctgccccgacagccgcgacgcctggccgccgctgcagagggccgccgcccactacggcgcccgccgcgtcgccgtcgtcgtccacctcttcccgctcccttaccacagcagcgccttcatggcttgccggtcgatccacacggtgcacaagctaaatgcgtcagccgtgtatcccctgctcgaaaacttcttcaaataccaggagggttattacaacatgccgacatacaccaaaacaagagcagcggtggtcgccgaaatagctaacaaccttgtcacccctgtcattggtgaggccaacttggcagcatacagagcgggcttcaacgactcacagtcagatcaggccacaaggatttccttcaagtttggttgtgcacgaggcgtcaccgggacaccctactactttgttaatggcataccactcagtgactctggttctcctatggactacaacaagtggatatccacacttgatccgttggttggcaagatgtagggagctatctcgctgcaaataaatatctccaaattgtaaccaatattagccaaataagtggaagacatacatagtttgatttttccataatgttgatggaagtatgtgttcattatcatgataatgtttgtaagtcaggcatgtagttccctcgatggcctccccccttgtgcacgcggaaattaattgacagctttggagcatgtttctcaaaaaaaaaaaaaaaa

SEQ ID NO: 5158 - protein, 229 aa, Triticum aestivum
  misc_feature: PFam Name: DSBA; PFam Description: DSBA-like thioredoxin domain
  misc_feature: GI Number: 8778978; NR Description: Contains similarity to pigpen protein from Mus musculus gb|AF224264 and contains protein of unknown function DUF78 PF|01918 domain. ESTs gb|N38077, gb|BE037702, gb|AV442191, gb|AV441368, T20H2.2 protein -
  misc_feature: GI Number: 8778813; NR Description: T4O12.23 [Arabidopsis thaliana]
MEPSRHRVPAAAALLVLVAVAAVVGRCGAQLPIPVRTDGFLYGGKSAAPAWGDAVVVEAFFDPVCPDSRDAWPPLQRAAAHYGARRVAVVVHLFPLPYHSSAFMACRSIHTVHKLNASAVYPLLENFFKYQEGYYNMPTYTKTRAAVVAEIANNLVTPVIGEANLAAYRAGFNDSQSDQATRISFKFGCARGVTGTPYYFVNGIPLSDSGSPMDYNKWISTLDPLVGKM

SEQ ID NO: 5159 - DNA, 1604 bp, Triticum aestivum
  misc_feature (1)..(1604): Ceres cDNA ID no. 22005607
  misc_feature (1)..(1604): Ceres CLONE  ID no. 754096
  misc_feature (1)..(1604): Also known as  Ceres CDNA ID no. 24407492
aagcaactccgtgatcgagagctctattccatccagccccgaagcagaggagagagctgtacgctggccggtaggctcatagctggagagatggtgctcaacggcgcactgttcttgctcgtctgcgcggctgctcgagctgctgcttccggcggagacggcccgctgctgaacggtaacttcgagtacgcgccgaacaggtcccagatgaacggctcgagggtgatggggaagtacgcgatcccgtactggaaggtggccggcttcgtggagtacatcgagtccggggcgaagcaggaccatatggtcctcatagtgccggaaggcaggcacgccgtgcggctgggcacgaactcctccgtccagcagcagctcagcgtgacgcggggcaagtactattccatcaccttcagcgcggcgcgcacctgcgcccagtccgagaagctgagcgtgtcgatcgtccccggcgacgcgtccggcggcgagctccccgtccagacggtgtacaccagcagcggctgggactcgtacgcctgggccttcaaggccaagcagggcgtggtgtcgctcatcatccaccacggcgacgaccaggtggacgaccccgcgtgcggccccatcgtcgacgccgtcgccatcagaacgctcagccctcctcacgccacccaccagaacatgctgatcaacggggacttcgaggaggggccgtacatgaccccggggtcgccgtcgggggtgctggtgccgcccatggacgaggacgccacgtcgccgctgccggggtggatgatcatgtcccactccaaggtggtcaagtacatcgacgcggggcacttccgggtgccgcacggctcccgcgccgtggagcttgtggccggcgtggaggtggcgctggtccaggaggtggccaccgtgcacggcaggtcctacaggctgcagttctccgtgggcgacgccggcaacaagtgcgcggcgtcgccgatgagcgtgcaggtggccacggcgtacgggggcaagcgcgtgtcgtacgagtcccgcggcacgggcggctacgtgcgcgacaagctcgacttcaaggcggaggggaacagcacccgggtggtgttctacagcacgggctaccacaccacgtccgaccgcagcggcacgctctgcggacccgtcgtcgacgacgtgtcgctcgtcagcgtctcgcacccgcatgctcgccggttgctccgctgatgcgcgtcgcaggagccggtgcttttttttttcttgatgagttgggagcccgtgctgctagaatgtgagtttctcgggagagagcggctcggaagtggaaaattgactgctgagaatgagatgatagtggttgcgtgacaacagacttaacattgcctcaacagattcatcatgattcactgcaaacagtatcaccgtaatcagctggaaacatcagcaacagctgcaatgttaagttttttttttcactttccttttcaaatcactttctctgcgtatgaaatgctgggtatgtgcccctgtcagtacatgtgttctactgtaaattcagtttggcatgtcgctgttgtaagctgtgactccgaaaaaaaaaaaaaaaa

SEQ ID NO: 5160 - protein, 377 aa, Triticum aestivum
  misc_feature: GI Number: 21554402; NR Description: unknown [Arabidopsis thaliana]
  misc_feature: GI Number: 16323310; NR Description: At1g29980/T1P2_9 [Arabidopsis thaliana] >gi|15010696|gb|AAK74007.1| At1g29980/T1P2_9
  misc_feature: GI Number: 56283929; NR Description: CG3047-PA [Drosophila melanogaster] gi|55380421|gb|AAF50957.4| CG3047-PA [Drosophila
  misc_feature: GI Number: 66776365; NR Description: PE-PGRS family protein [Anaeromyxobacter dehalogenans 2CP-C] >gi|66857891|ref|ZP_00401930.1| PE-PGRS family protein
MVLNGALFLLVCAAARAAASGGDGPLLNGNFEYAPNRSQMNGSRVMGKYAIPYWKVAGFVEYIESGAKQDHMVLIVPEGRHAVRLGTNSSVQQQLSVTRGKYYSITFSAARTCAQSEKLSVSIVPGDASGGELPVQTVYTSSGWDSYAWAFKAKQGVVSLIIHHGDDQVDDPACGPIVDAVAIRTLSPPHATHQNMLINGDFEEGPYMTPGSPSGVLVPPMDEDATSPLPGWMIMSHSKVVKYIDAGHFRVPHGSRAVELVAGVEVALVQEVATVHGRSYRLQFSVGDAGNKCAASPMSVQVATAYGGKRVSYESRGTGGYVRDKLDFKAEGNSTRVVFYSTGYHTTSDRSGTLCGPVVDDVSLVSVSHPHARRLLR

SEQ ID NO: 5161 - DNA, 1710 bp, Triticum aestivum
  misc_feature (1)..(1710): Ceres cDNA ID no. 22005608
  misc_feature (1)..(1710): Ceres CLONE  ID no. 759154
  misc_feature (1)..(1710): Also known as  Ceres CDNA ID no. 24407975
acgaagaatcaagcagcaaaaaatggaggccaccaccctgcggaagcggccgctctcggtcaagacggccgccggacgcgaagggcggacggcggccgaagcagagctgggggagccggtcagcccctccgcgaggctggtggaggacttctacatcatcgtcctcatgggcgcctccacgcccctcaacctccccgccctccgcgccggcatcgaggcccagctcgcacgctacccacacttccgcagcatccaggtgacggacagggacggcgagctgcggtggttgccgacgacggtgaacgtggacaaccacctcatccgcccgacgctggacccggccgccgtggcggccaacccggacaaggccgtagaggactacgtggcgtcgctgtccacgctgcccatggaccggtcccagccgctgtgggagttccacctcttcgacttcccgacctccgaggcgacctccaccgccgcgatccgcgtgcaccactccctcggggacggcatgtcgctgctcacgctcctcatggcctgcacgcgcagcgccgccgacccgaccaggctgccggccatgccgccgctaccgacgcgcacgggcgccatctaccagcgcccgcgcccttcggcgggcgtcctggcgttcctcgcgtgggtctggtcgttcgtcgtgctcgcctggcacaccgtggtggacgtcgtcggcttcttcgcgaccatactgttcttgaaggatccgcacacgctgttcaagcgggtgaaccacgcggagacgcagcgcaagcgcatcgtgcaccggaggcttagcctcgacgacgtcaagttcgtcaagaacgccatgaaatgcacagttaacgatgtgttgattggagtcacatacgctgccctgtcgcgctatcacttccgaaagtcaggtgaaaccgacactcataaagagatacgggtacgctcgatgcttctcgtcaacttaaggccgaccacaagcctacacgcatgcgttgatatgataaagtcgggcaaagaaagccacgtggaatggggaaatgaacttgggttcatcatccttccgttcttcatcggcatgcacagcgacccactcgactacgttcgcaaggggaagaaggttgtggacaggaagaagagctcactggaggtggtattcacacatgtcgccgcagaagtgatcttcaaagtgtttagactgaaggcagcttcggctatcttccatcgtatgatctcccataccactatatcattcgccaacatgactggcccggttgaacaggtcgagttttgtgggcatccaatcgtcttcatcgcccctagcggctatggaccgccagaagccctaaccgtgaattatcaaagctatgtcaacaccatcatgataaatctagcactggatgagggacactttcctgactatgatgaacttttggatgactttgttgaatcccttgagcatattaaggatgcagcttcacgccttggaatgcatcataggaaggcctaaagctatttgcatcagtgcaatatattcatgatttcgctactgtgccattcaatattactgatggactatgctcccttggtccagaactgtaaggtgcataattaatgagtatacacgaataatattattgtagtcttgcaaaattcatttctgctatatatcttttcacattcaacacaaaaaaaaaaaaaaaa

SEQ ID NO: 5162 - protein, 497 aa, Triticum aestivum
  misc_feature: PFam Name: Condensation; PFam Description: Condensation domain
  misc_feature: GI Number: 34909902; NR Description: P0665A11.11 [Oryza
  misc_feature: GI Number: 34911182; NR Description: P0019E03.6 [Oryza sativa (japonica cultivar-group)] >gi|21644692|dbj|BAC01248.1| P0019E03.6
  misc_feature: GI Number: 38154365; NR Description: melanocortin 1 receptor
MEATTLRKRPLSVKTAAGREGRTAAEAELGEPVSPSARLVEDFYIIVLMGASTPLNLPALRAGIEAQLARYPHFRSIQVTDRDGELRWLPTTVNVDNHLIRPTLDPAAVAANPDKAVEDYVASLSTLPMDRSQPLWEFHLFDFPTSEATSTAAIRVHHSLGDGMSLLTLLMACTRSAADPTRLPAMPPLPTRTGAIYQRPRPSAGVLAFLAWVWSFVVLAWHTVVDVVGFFATILFLKDPHTLFKRVNHAETQRKRIVHRRLSLDDVKFVKNAMKCTVNDVLIGVTYAALSRYHFRKSGETDTHKEIRVRSMLLVNLRPTTSLHACVDMIKSGKESHVEWGNELGFIILPFFIGMHSDPLDYVRKGKKVVDRKKSSLEVVFTHVAAEVIFKVFRLKAASAIFHRMISHTTISFANMTGPVEQVEFCGHPIVFIAPSGYGPPEALTVNYQSYVNTIMINLALDEGHFPDYDELLDDFVESLEHIKDAASRLGMHHRKA

SEQ ID NO: 5163 - DNA, 1582 bp, Triticum aestivum
  misc_feature (1)..(1582): Ceres cDNA ID no. 22005609
  misc_feature (1)..(1582): Ceres CLONE  ID no. 763803
  misc_feature (1)..(1582): Also known as  Ceres CDNA ID no. 24407762
atcaatccggaccatcttccctagctagcaagtagaaatggctgaccaagccaagctttcccgccacaacccctatacgaaccatgtgttccatcgtgtcatcatctcggcactcgtcctgctgctgtcctgcacggcggcgaccagtgaccggcaaccaccactgatctcccagctcgccaaggaccccgagacctccctctataccatctccgtcaaggctgacaagtcgccgctcctcctcgacctcgccggctcgctcgtgtggtcgacgtgcccgccctcgtcggcgcacagcacggtgccgtgcgaatccgacacgtgcgccgtggccaaacagcagtcctcgcatcgctgccggtacgtggacggcggccggttctgggagaaccgcgagccggggccgtcgtggtgcgcctgcgccgctcgcccgctcaacccggtcaccggccagtgctccaccggcgatctcacgagcctcaccatgaaagccaacaccaccaacggcaccatggagctgcgcccggaggagtcgttcgccgtcgtcggcgcgtgcgcgccgggccgcctactgggttcgctccccgcaggcgccgccggcgtcgcggggctctcccgtcgttcgctctcgctgccgtcccagctcgtggctcagcgcggcttcggacgcaagttctccctgtgcctccccgccttcgcgaccttcggcgacacgccggtgtacctgcccacgccggagcgaggcttcatcgactacacgacctccatcccgtacaccccgctcctaaccaacccggcgaacgccggcggatactacatccccgtcaagggcatctccgcgtcgtggcacggggcggacgcggcggcggccctgccccgtggcgcgctcgacattgacgtccgcacggggcgcggcggcgtcgtgctgagcacggccacgccgtacacggtcatgcggcccgatgtgttccgcgctttcgccaaggccttcgaccacgccataataagagggaaggtgagcttcatggaaagggtgccggcgacgaagccgttcgagctgtgctacaacggcgcgttcccgatgctgaagcgagctggcctcgacatgccttacattaaacttgagctgggcgacggcgccacgcgcaactggacactgttcaatgataactacatggtgccagtggatggtgcgatgtgcgtggggatcctgccgatggggcccgatggcatgccggtcgacggcgagccggcggtggtgatcggcgggaaacagctggagaacaacctgctggtgttcgatctggagaaacaggtgctcgggttcagcatgcttctgagcgtccaattgtccggctgtcgaagctcctatttcttcagaaactaaacactagtgggtttgccggccagctcgttctttaccttttcagcaggtgtaaaagtatgtgagtttgtcaggctgacattctacacacactgtagtcacttcaatttcacttggacgggttagaactttcactgtatctgtactgtgtacttgcaataaacacgtatcttttttacttgaaaaaaaaaaaaaaaa

SEQ ID NO: 5164 - protein, 449 aa, Triticum aestivum
  misc_feature: PFam Name: Asp; PFam Description: Eukaryotic aspartyl protease
  misc_feature: PFam Name: Peptidase_S8; PFam Description: Subtilase family
  misc_feature: PFam Name: Pkinase; PFam Description: Protein kinase domain
  misc_feature: GI Number: 34907234; NR Description: P0504E02.13 [Oryza sativa (japonica cultivar-group)] >gi|20160770|dbj|BAB89711.1|
  misc_feature: GI Number: 34907236; NR Description: P0504E02.14 [Oryza sativa (japonica cultivar-group)] >gi|20160771|dbj|BAB89712.1|
  misc_feature: GI Number: 34907240; NR Description: P0504E02.16 [Oryza sativa (japonica cultivar-group)] >gi|20160773|dbj|BAB89714.1|
  misc_feature: GI Number: 34907218; NR Description: putative dermal glycoprotein precursor [Oryza sativa (japonica cultivar-group)] >gi|20160762|dbj|BAB89703.1| putative dermal glycoprotein precursor
  misc_feature: GI Number: 57899195; NR Description: putative xylanase
MADQAKLSRHNPYTNHVFHRVIISALVLLLSCTAATSDRQPPLISQLAKDPETSLYTISVKADKSPLLLDLAGSLVWSTCPPSSAHSTVPCESDTCAVAKQQSSHRCRYVDGGRFWENREPGPSWCACAARPLNPVTGQCSTGDLTSLTMKANTTNGTMELRPEESFAVVGACAPGRLLGSLPAGAAGVAGLSRRSLSLPSQLVAQRGFGRKFSLCLPAFATFGDTPVYLPTPERGFIDYTTSIPYTPLLTNPANAGGYYIPVKGISASWHGADAAAALPRGALDIDVRTGRGGVVLSTATPYTVMRPDVFRAFAKAFDHAIIRGKVSFMERVPATKPFELCYNGAFPMLKRAGLDMPYIKLELGDGATRNWTLFNDNYMVPVDGAMCVGILPMGPDGMPVDGEPAVVIGGKQLENNLLVFDLEKQVLGFSMLLSVQLSGCRSSYFFRN

SEQ ID NO: 5165 - DNA, 1681 bp, Triticum aestivum
  misc_feature (1)..(1681): Ceres cDNA ID no. 22005611
  misc_feature (1)..(1681): Ceres CLONE  ID no. 777158
  misc_feature (1)..(1681): Also known as  Ceres CDNA ID no. 23719435
atgcgcacacatggggatggcatttttgccaccctcgtgttgcggtttggttccagatccagtgacactgctcgccacgagacaagagctccctgcacctgcctcccggcccagctcaccggcgaagaatatcttaagcatacaatcacaactcacaagctgcgtccgtccagttgcagtcgccacccaccaccactagagccatcaccacatcaaagaggcagaggacaaaaaagaatccgcacttgcttggctttccagctagtaattcaggttgccgtccggttactggctcggctcccaggtgatacagatcggcctctcacggcgtcggcggatcggctagcagcaatggcgcgcgcgttcggcgtcggcgctgcggtgctcgtcgtcgtgtcggccttcttcgcgccggcactagtgacggcgcagaccggcagctgcgacgacccgctgccgaccgagctcgtcggcaactactccgggctggcctgcagccccgtctggaacaacttcgtgctccggtacgcgcagggcggggacaacgtgctgcgggtggtgctctcggcgatgtacagctccgggtgggtggggatggccttctccaaggacggcctcatggtgggctcgagcgccatggtcgggtgggtcggcaagaaggggcaagcccacgtcaagcagtttgccctcaacggcaaggcgccctccatggtcgtcgccgacaggggcttcctcgtctccaacggccacgcccacaccgtcctcgtcaagcaggccaagatctacctcgccttccagctcaacttcgactcgcagctcaagaagcagcaggtgctcttcgccttcggctctgccatccctgtcaacgaccgcctagccgagcaccagggcaagacgtccatcacctttgatttcaccacaggcagctcttcaggctcctccttcccgagtggcctaaaaaggactcatggggcactcaacctgttcgcttggggtgtcctcctgcctatcggtgccattatcgctcggtactgcaggggttgggaccctctgtggttctaccttcatggcggcattcagttcgtcggcttcatcctcggtctggccggcgttgtggctggagtatcactctacggcaagatccaagcagatgttccagcacatagaggccttggcatatttgtgcttgtgcttggtatcctccagattcttgcattcttcctacggcccaacaaagactcgaagtaccggaaatactggaactggtatcaccattgggtaggcaggcttgtgctcttctttgcagcagtcaacattgtcttgggaatcaaagttggaggcgctggtaacccctggaagatcggctatgggtttagcctggccatccttctgatcaccattatcaccctggaagtcctggtgtggacaaggaggaaaaacaacagcggtgctacgacgacatactaactatgcttgactagggttcttgttctgtgagctgctgaaggccctattattttcattcgttttcttcttcttcttatgctgttgttgtaagcatgtaatctattctgcagaatcttttagcagggatctgcgagactagtctatcggtgatgtgttttggatttgaaatgtgtagagtgtttgaatgtactactccataaaaaaaaaaaaaaaa

SEQ ID NO: 5166 - protein, 1681 aa, Triticum aestivum
  misc_feature: PFam Name: DOMON; PFam Description: DOMON domain
  misc_feature: PFam Name: Mucin; PFam Description: Mucin-like glycoprotein
  misc_feature: GI Number: 34911180; NR Description: P0019E03.5 [Oryza sativa (japonica cultivar-group)] >gi|21644691|dbj|BAC01247.1| P0019E03.5
  misc_feature: GI Number: 30680365; NR Description: membrane protein,
  misc_feature: GI Number: 34907602; NR Description: B1078G07.42 [Oryza sativa (japonica cultivar-group)] >gi|20161294|dbj|BAB90220.1| B1078G07.42 [Oryza sativa (japonica cultivar-group)] >gi|21952847|dbj|BAC06262.1| P0696G06.19 [Oryza sativa (japonica
  misc_feature: GI Number: 57899814; NR Description: membrane protein-like
  misc_feature: GI Number: 34907596; NR Description: B1078G07.39 [Oryza sativa (japonica cultivar-group)] >gi|20161291|dbj|BAB90217.1| B1078G07.39 [Oryza sativa (japonica cultivar-group)] >gi|21952844|dbj|BAC06259.1| P0696G06.16 [Oryza sativa (japonica
ATGCGCACACATGGGGATGGCATTTTTGCCACCCTCGTGTTGCGGTTTGGTTCCAGATCCAGTGACACTGCTCGCCACGAGACAAGAGCTCCCTGCACCTGCCTCCCGGCCCAGCTCACCGGCGAAGAATATCTTAAGCATACAATCACAACTCACAAGCTGCGTCCGTCCAGTTGCAGTCGCCACCCACCACCACTAGAGCCATCACCACATCAAAGAGGCAGAGGACAAAAAAGAATCCGCACTTGCTTGGCTTTCCAGCTAGTAATTCAGGTTGCCGTCCGGTTACTGGCTCGGCTCCCAGGTGATACAGATCGGCCTCTCACGGCGTCGGCGGATCGGCTAGCAGCAATGGCGCGCGCGTTCGGCGTCGGCGCTGCGGTGCTCGTCGTCGTGTCGGCCTTCTTCGCGCCGGCACTAGTGACGGCGCAGACCGGCAGCTGCGACGACCCGCTGCCGACCGAGCTCGTCGGCAACTACTCCGGGCTGGCCTGCAGCCCCGTCTGGAACAACTTCGTGCTCCGGTACGCGCAGGGCGGGGACAACGTGCTGCGGGTGGTGCTCTCGGCGATGTACAGCTCCGGGTGGGTGGGGATGGCCTTCTCCAAGGACGGCCTCATGGTGGGCTCGAGCGCCATGGTCGGGTGGGTCGGCAAGAAGGGGCAAGCCCACGTCAAGCAGTTTGCCCTCAACGGCAAGGCGCCCTCCATGGTCGTCGCCGACAGGGGCTTCCTCGTCTCCAACGGCCACGCCCACACCGTCCTCGTCAAGCAGGCCAAGATCTACCTCGCCTTCCAGCTCAACTTCGACTCGCAGCTCAAGAAGCAGCAGGTGCTCTTCGCCTTCGGCTCTGCCATCCCTGTCAACGACCGCCTAGCCGAGCACCAGGGCAAGACGTCCATCACCTTTGATTTCACCACAGGCAGCTCTTCAGGCTCCTCCTTCCCGAGTGGCCTAAAAAGGACTCATGGGGCACTCAACCTGTTCGCTTGGGGTGTCCTCCTGCCTATCGGTGCCATTATCGCTCGGTACTGCAGGGGTTGGGACCCTCTGTGGTTCTACCTTCATGGCGGCATTCAGTTCGTCGGCTTCATCCTCGGTCTGGCCGGCGTTGTGGCTGGAGTATCACTCTACGGCAAGATCCAAGCAGATGTTCCAGCACATAGAGGCCTTGGCATATTTGTGCTTGTGCTTGGTATCCTCCAGATTCTTGCATTCTTCCTACGGCCCAACAAAGACTCGAAGTACCGGAAATACTGGAACTGGTATCACCATTGGGTAGGCAGGCTTGTGCTCTTCTTTGCAGCAGTCAACATTGTCTTGGGAATCAAAGTTGGAGGCGCTGGTAACCCCTGGAAGATCGGCTATGGGTTTAGCCTGGCCATCCTTCTGATCACCATTATCACCCTGGAAGTCCTGGTGTGGACAAGGAGGAAAAACAACAGCGGTGCTACGACGACATACTAACTATGCTTGACTAGGGTTCTTGTTCTGTGAGCTGCTGAAGGCCCTATTATTTTCATTCGTTTTCTTCTTCTTCTTATGCTGTTGTTGTAAGCATGTAATCTATTCTGCAGAATCTTTTAGCAGGGATCTGCGAGACTAGTCTATCGGTGATGTGTTTTGGATTTGAAATGTGTAGAGTGTTTGAATGTACTACTCCATAAAAAAAAAAAAAAAA

SEQ ID NO: 5167 - DNA, 2291 bp, Triticum aestivum
  misc_feature (1)..(2291): Ceres cDNA ID no. 22005612
  misc_feature (1)..(2291): Ceres CLONE  ID no. 777451
  misc_feature (1)..(2291): Also known as  Ceres CDNA ID no. 24408532
cctctgtataaatctccctcgctccccccactgaacccagcacccatccgtcgccgagaaataatatctaccaaattcccacgggattctcgtggcgagcgccggcgccatggagtcctcacgcggcatcctcatccccggcacgccgccgctgccctacgcgtacgagccgctgccctcctcctccgccgacgccaacggccaggaggaccggcggaccagcggcggcgtcaggtggcgcgcgtgggccaccgtgctggctgtggtggcgctcgtcgtcgccgccgcggtctttggggccagcagggtcgaccgggacgcggtggtctcctccgcgtcggctacggcggtccacggcgtgtccggggcatattcctcccacggcggcttcccgtggagcaacgccatgctggagtggcagcgcaccggctaccatttccagccggagaagaactaccagaacgatcccaacggtccggtgtactacaaaggatggtaccacttcttctaccagcacaacccggggggcaccggatggggcaacatctcatggggccatgccgtgtcgcgggacatggtccactggcgtcacctaccgctcgccatggtgcccgagcactggtacgacatcgagggcgtcctcaccggatccatcaccgtgctccccgacggcagggtcatcctgctctacacagggaacaccgagacgtttgcgcaggtgacctgcctcgcggaggccgccgacccaagcgatcccctcctccgtgagtgggtcaagcaccccgccaatcccgtcgtgtacccgccccccggcatcggcatgaaggactaccgtgacccaaccacggcgtggttcgacaactccgacaacacgtggcgcatcatcattggctccaagaacgacacggaccactccggcatcgtcttcacgtacaagaccaaggacttcgtcagctacgagctgataccgggatacttgtaccgcggccccgccggcaccggcatgtacgagtgcatcgacatgttcgccgtcggcggtggccgcaaggccagcgacatgtacaattcgacggccaaggacgtgctgtacgtgctcaaggagagcagcgacgacgaccggcgcgactattacgcgctcgggaggttcgacgcggcggccaacacatggacgccgatcgacaccgagcgggaactcggcgtcgcgctgcggtacgactatggcaggtacgacgcgtccaagtccttctacgaccccgtgaaggagcggcggatcgtctgggggtacgtcgtcgagaccgactcctggagtgccgatgcggccaaggggtgggccaaccttcagtcgattccgagaacggtggagcttgacgagaagacccggacaaacctcatccaatggccggtggaggagctcgataccctccgcatcaacaccaccgatctcagcggtatcactgtcggtgccggatccgtcgtctccctccccctccaccagacctcccaactcgacatcgaggcatcgttccgcatcaacgcctccgccatcgaggccctcaatgaggtcgacgtcagctacaactgcaccatgaccagtggcgccgccacccgcggcgcgctcggccccttcggcattctcgtcctcgccaacgccgccctgacagaacagacggcggtgtacttttatgtgtccaagggcctcgacggcgttcttcgaacgcacttctgccacgatgagttgcggtcgacgcatgccattgatgtggcgaaggaggtggtgggtagcacggtgccggtgctcgacggcgaggatttttctgttagggtgctcgtggaccactccatcgtgcagagcttcgtcatgggcgggaggatgacggcgacgtcgagggcgtacccgacggaggccatttacgcggcggcgggggtctacctgttcaacaatgccaccagcgccaccatcaccgctgagaagctcatcgtgcacgacatggattcgtcgtacaaccgcatattcacggacgccgacttggtagtcctcgattagactgatcacttacaacaagtaatggattttttgctcggtccgtggagcttccttttatcttggacagatttttagcggtggagcaccagcaagtctacctgtcatcttgatttatgtttttggttccggttttggttttagtaagatgaattagatgatgttggtcacctgtaaatcaattacgggtaaattaaaagggcatggatgccaccaaatataagtgactatttcaaaaaaaaaaaaaaaa

SEQ ID NO: 5168 - protein, 644 aa, Triticum aestivum
  misc_feature: PFam Name: Glyco_hydro_32; PFam Description: Glycosyl
  misc_feature: PFam Name: Pyr_redox_2; PFam Description: Pyridine
  misc_feature: PFam Name: MAGE; PFam Description: MAGE family
  misc_feature: PFam Name: Extensin_2; PFam Description: Extensin-like region
  misc_feature: PFam Name: Podocalyxin; PFam Description: Podocalyxin
  misc_feature: GI Number: 62176934; NR Description: acid
  misc_feature: GI Number: 1857714; NR Description: acid beta-fructosidase [Capsicum annuum] >gi|7435475|pir||T09534 probable beta-fructofuranosidase (EC 3.2.1.26) - pepper >gi|3913925|sp|P93761|INV1_CAPAN ACID BETA-FRUCTOFURANOSIDASE
  misc_feature: GI Number: 2150134; NR Description: acid invertase [Asparagus
  misc_feature: GI Number: 18146714; NR Description: acid invertase [Citrus unshiu]
  misc_feature: GI Number: 33359653; NR Description: acid invertase [Solanum
MESSRGILIPGTPPLPYAYEPLPSSSADANGQEDRRTSGGVRWRAWATVLAVVALVVAAAVFGASRVDRDAVVSSASATAVHGVSGAYSSHGGFPWSNAMLEWQRTGYHFQPEKNYQNDPNGPVYYKGWYHFFYQHNPGGTGWGNISWGHAVSRDMVHWRHLPLAMVPEHWYDIEGVLTGSITVLPDGRVILLYTGNTETFAQVTCLAEAADPSDPLLREWVKHPANPVVYPPPGIGMKDYRDPTTAWFDNSDNTWRIIIGSKNDTDHSGIVFTYKTKDFVSYELIPGYLYRGPAGTGMYECIDMFAVGGGRKASDMYNSTAKDVLYVLKESSDDDRRDYYALGRFDAAANTWTPIDTERELGVALRYDYGRYDASKSFYDPVKERRIVWGYVVETDSWSADAAKGWANLQSIPRTVELDEKTRTNLIQWPVEELDTLRINTTDLSGITVGAGSVVSLPLHQTSQLDIEASFRINASAIEALNEVDVSYNCTMTSGAATRGALGPFGILVLANAALTEQTAVYFYVSKGLDGVLRTHFCHDELRSTHAIDVAKEVVGSTVPVLDGEDFSVRVLVDHSIVQSFVMGGRMTATSRAYPTEAIYAAAGVYLFNNATSATITAEKLIVHDMDSSYNRIFTDADLVVLD

SEQ ID NO: 5169 - DNA, 2000 bp, Triticum aestivum
  misc_feature (1)..(2000): Ceres cDNA ID no. 22005613
  misc_feature (1)..(2000): Ceres CLONE  ID no. 783812
  misc_feature (1)..(2000): Also known as  Ceres CDNA ID no. 24412123
cacgcccaataatttacctccctcccctaccatctcctctggaagcgtcgcgtctggtcctacccaaatccgccacgcaacccggcatttccgccacttgtgatggcggcggcggcgaggcaccggaaggaggaggaggacgagatgctgctggacgacggcgacatcgaggagagcccccgcgacagcttccgcgactccgacgacgacgacgacgaggcggaggaggcgcggggcgaggatggcgacggggtcggctccttcgagtcgcaccagtggccgcagagttaccgggaaacaactgacacatacacaattgctgcatctcccatcttcggttacctgggtccttcaaccagtaaatactcaatcgatggcggccgcagtggcctggcttctgacctcaggctgcctttcatctcggataagctagaatctgtcaagagcctgcggcgacatcttcttggttcagttagagacgagaagctctcgtttcagtatactggagagatctacgtcggtcaagggtgcagcgtgacacagacagtcttcaatggtattaacgtactcgctggtgttggccttctttccgctccgttcacaattcatgaagctggatgggctggtcttgcagttctgtctgtttttgcaattatttgctgctatactggagttcttctcaaacattgtttcgagagcaaagacggtattgcaacctatccagacatcggggaggccgcctttggaagaattggccgcttgatcatatctattattttgtatactgaattatattcatactgcgtggaattcattatactggaaggtgataacatgacatcaatctttcctgacgtcaacattaatttgtttgggattcatgtcgacagtaaacatttctttggagtgttaactgctctggtagttctgcccacagtatggctgcgagatcttcgagtgctatcatatctttcagcgggtggtgtgattgcaactcttgtggtgtttatatctgtcgctttagtcggtactactgaaggtatagggttccatcagaccggagaagctgtaaagtggagtggcatgccctttgcaattggtatttacggtttctgctactctgggcattcggtatttcccaatatctaccaatcaatgtctgatcgcacaaaattccctaaggcactctttatatgcttcgcagtttgcacagcaatatatggctcgtttgctattattggctatctcatgtttggtgacaagactctgtcgcaaataactttgaatcttccaaaagagtcatttgcctcgaaagttgctctgtggaccacggtgatcaaccctttcaccaaatttgccttgttgttaaacccattggctcggagtttagaagagttgcgccccgaaggatttttgaacgaaacaatcgtctctattatactgaggacgagccttgtggcgtcaactgttgtcattgcatttcttcttccattcttcggtttggtgatggctctgattggatccctgctcagtatacttgtggcagtcataatgccggccttgtgcttcttgaagatcgcacagaataaagccacacgcccgcaggtgattgcaagcgtggctataatagtggttggagtcatcagtgctgccctcggaacatactcctcggtggctagcataatcggatactactaattcttccaaagcaatctcttcgacagctctcagtaccgtcactcttggcaagagtttttgctgtgtatcatcgaattttaccgtgctctatgtacatccttcgacctagtatagtcgatttataaagactgcatctctagcaacaatgcactactgttaccatttagctgctgctatatcatttggtgtaccatatttctgccaagccctgcggtttaaatattgcctctttttagggctaaaaccaactttagtaacccgaaatattgtttgttgctattcatttaaaaaaaaaaaaaaaa

SEQ ID NO: 5170 - protein, 531 aa, Triticum aestivum
  misc_feature: PFam Name: Aa_trans; PFam Description: Transmembrane amino
  misc_feature: GI Number: 50904567; NR Description: putative amino acid transport protein [Oryza sativa (japonica cultivar-group)] >gi|41053220|dbj|BAD08181.1| putative amino acid transport protein
  misc_feature: GI Number: 50915446; NR Description: amino acid transporter-like [Oryza sativa (japonica cultivar-group)] >gi|47497045|dbj|BAD19097.1| amino acid transporter-like [Oryza sativa (japonica cultivar-group)] >gi|47497767|dbj|BAD19867.1|
  misc_feature: GI Number: 30687791; NR Description: amino acid transporter
  misc_feature: GI Number: 42563875; NR Description: amino acid transporter
  misc_feature: GI Number: 42563873; NR Description: amino acid transporter
MAAAARHRKEEEDEMLLDDGDIEESPRDSFRDSDDDDDEAEEARGEDGDGVGSFESHQWPQSYRETTDTYTIAASPIFGYLGPSTSKYSIDGGRSGLASDLRLPFISDKLESVKSLRRHLLGSVRDEKLSFQYTGEIYVGQGCSVTQTVFNGINVLAGVGLLSAPFTIHEAGWAGLAVLSVFAIICCYTGVLLKHCFESKDGIATYPDIGEAAFGRIGRLIISIILYTELYSYCVEFIILEGDNMTSIFPDVNINLFGIHVDSKHFFGVLTALVVLPTVWLRDLRVLSYLSAGGVIATLVVFISVALVGTTEGIGFHQTGEAVKWSGMPFAIGIYGFCYSGHSVFPNIYQSMSDRTKFPKALFICFAVCTAIYGSFAIIGYLMFGDKTLSQITLNLPKESFASKVALWTTVINPFTKFALLLNPLARSLEELRPEGFLNETIVSIILRTSLVASTVVIAFLLPFFGLVMALIGSLLSILVAVIMPALCFLKIAQNKATRPQVIASVAIIVVGVISAALGTYSSVASIIGYY

SEQ ID NO: 5171 - DNA, 1676 bp, Triticum aestivum
  misc_feature (1)..(1676): Ceres cDNA ID no. 22005615
  misc_feature (1)..(1676): Ceres CLONE  ID no. 787752
  misc_feature (1)..(1676): Also known as  Ceres CDNA ID no. 25088319
atctttaattgtcaccatggcggctcagctagtggcagcactcttatctccacaagcactatcgctttatctcctgctcctccctatcgtcctcctctactactcggcaacaaaaacaaagagatcggggagcgagcaggctgcggcggtgggccatggcgaagagcgcccccttcctgcgcctccgagtaagctccctctcatcggccacctccacctcatcggcaccaacccccacgtctccctcgccgcgctcaccgcccagcacggcgacggcgggatcctgctgctccacctgggccaggtgcgcaatctcgtggtcactaccccgggcgccgcggaggcggtgcttcgcacgcacgaccacgtcttcgcgtcgcgccggcagaacgcgttcgccgacacgctcctcgacggctccgacatcgccttcgccccctacggcaagttctggcggcagctgaggcggctggtcaccacgcacctgctcagcgccaggaaggtgctgtcgctccgcgctggtcgcgaggaggaggcacgcctggtcatggccaagatccgcgacgctgcggccgccggcgccgccgtggacgtgtccacgctgctcgccaccttcaccaacgacgtcgcttgccgcgccgtgtccggcaagttcttccgggaggaaggccggaacgagctgttccgggaggtgatcgacggcaacgtcgcggcgttcggggggttcaacccgcaggactacttcccgagcctggccaaggtggacgcgctggcgcgggtgctgttccccaagatgactcggctgaggaagaggtgggacgggctgctcgacaggatcatcgacgaccacgccaccaaatcatcgctgcagcaagaagaagatgaggaggagacagacttcgtggacgttctcctcgctcgtcaacacgagtacagtctcaccaggcagcatatcaaggccattttggtggacatgtttgtagctgggacggacacgtcatacgtagtcctagagttcgccatggccgagctcatgcgaaagccacacctcatggccaaactccaagccgaggtaagggaaaagacaccaaagggccaaccaatggtcatggaggatgacttgggcggcatgacctacctaaaggcggtcttgaaggagacgctccggctgcacccaccattgcccctcctcctcccacacttctctgtggacaagtgtgtcattaacggctacacagtccccgccgaaactcgtgtcatcatcaatgtgtgggccatcggcagagaccctgggtcgtgggaggatgcggaggagttcatccctgagaggttcgaggacatcgcgtcccccgactacaaggggagggattttgggatcctgccgtttggagccggtcgaaggatatgtcccgggataaactttggcatggcctccgtggagattatgctcgccaaccttgcatattgctttgattgggagctcccgggtgggatgcagcacaaggacctcaatatgtcagaggtgtttggaatgacgatacaccgggaggagaagctaattcttgtcccaacaacacgagatgttagtcatgaataatatatagtttacatgcacttgtaagggtatagatgctatagtacttaagagtgttatttttggaaaaaaaaaaaaaaaa

SEQ ID NO: 5172 - protein, 526 aa, Triticum aestivum
  misc_feature: PFam Name: p450; PFam Description: Cytochrome P450
  misc_feature: GI Number: 19909888; NR Description: P450 [Triticum aestivum]
  misc_feature: GI Number: 19909892; NR Description: P450 [Triticum aestivum]
  misc_feature: GI Number: 19909894; NR Description: P450 [Triticum aestivum]
  misc_feature: GI Number: 62148964; NR Description: P450 [Triticum aestivum]
  misc_feature: GI Number: 26655531; NR Description: cytochrome P450
MAAQLVAALLSPQALSLYLLLLPIVLLYYSATKTKRSGSEQAAAVGHGEERPLPAPPSKLPLIGHLHLIGTNPHVSLAALTAQHGDGGILLLHLGQVRNLVVTTPGAAEAVLRTHDHVFASRRQNAFADTLLDGSDIAFAPYGKFWRQLRRLVTTHLLSARKVLSLRAGREEEARLVMAKIRDAAAAGAAVDVSTLLATFTNDVACRAVSGKFFREEGRNELFREVIDGNVAAFGGFNPQDYFPSLAKVDALARVLFPKMTRLRKRWDGLLDRIIDDHATKSSLQQEEDEEETDFVDVLLARQHEYSLTRQHIKAILVDMFVAGTDTSYVVLEFAMAELMRKPHLMAKLQAEVREKTPKGQPMVMEDDLGGMTYLKAVLKETLRLHPPLPLLLPHFSVDKCVINGYTVPAETRVIINVWAIGRDPGSWEDAEEFIPERFEDIASPDYKGRDFGILPFGAGRRICPGINFGMASVEIMLANLAYCFDWELPGGMQHKDLNMSEVFGMTIHREEKLILVPTTRDVSHE

SEQ ID NO: 5173 - DNA, 1720 bp, Triticum aestivum
  misc_feature (1)..(1720): Ceres cDNA ID no. 22005616
  misc_feature (1)..(1720): Ceres CLONE  ID no. 793273
  misc_feature (1)..(1720): Also known as  Ceres CDNA ID no. 24408544
atgaatgctcttctgttgtttccaggcaccatcctccatttctttccctcgaaaaaaaggctccctcctccacgagacgcggaggcaccaccggccgccgccgccatctccgcccacctcgaccatctcttgcggcagctcgctcctcctccctccccaccgacggcggcggcatggactgccccaagcggagcgcgagcgccggcctccccgaagactccttggtggagatcctcgcgcgcgtccccgccaggtccgtctaccgctccaagtgcgtcgcgaaggcatggcgcgacctcatcgaagatcccctccaccgcaagaaactcccccaaaccctacaaggcttcttcctcattgacaaggagacccataggcagcgtgtctgcttcgcaaatctgcttgatagatccgggcctctccagatcgaccgtaacctcgccttcctgaaggaatcgcccgggattgggactctcgacttctccgattcctgtaacgggctcctcctcttcgagcacaaactggaggcatggccatataatctattgggctatgtcgtatgcaaccccgccacgaagcagtgggtggaggtgcccagagacggccctccgcttccgttgtatcttcggcaacccaaaaggttcaactatttggtttttgatccgtccgtctcctctcacttccacctggtccagttcacgtgggagtttgtgcgcttggtgaagtttgaggaggaggagctagtggttggtcatgatgatgatgatgatgatggggaggaggaggaggagggcgatgaggaggaggaggtgtcccggacgtcagtgcacgtctactcctctgagactgacaagtggactcacacgcaaagtgactggagtcaagtccaaagtggccggaacaagcatgatttggaaggatggcgccttcagggcttaatacctgagagcttctgctgtgctgttctcaacagcatgctgcatttcataatttcggatgaaggtcagattgctgctgttgacatgcaaggggtgacacgaaagatcatcccagtgccgacgatggccgagaggctccactggctggagcctggttgtgttgcccaatcccaagggcgcctgcactacatcagtcaagcagttgatggtcgactgtccatctgggttctggagggctatgatacacaagaatgggtcttgaagcatagtgtgagctttacggggctgtttagagaaaagagacgcacaggcgacacaaaagactacagtgtggttgccatgcatccagatggaaatgtggttttcattgttcaggattggaaccgaaagatgatatcatatcacacggacaataagctagtgagtgttattgggacattaaaaaatgatgcttcagatatgcatgttgtaacttatgttccctgtttctccgagtcaccggcactcccaatcaagcactgaatgtgttgcgttcatctacacagaagatagcaacttggttagatctagtagaattgggtgatatattatgcccatggttggatgtatccttctcatgcttttggtccaagtaatagtgcaaggcagttgagacattcttgtcaggtagtttcatgtatgctagattagtaaatgatgttgcccaagttgcatataattttgaagtgttaatgcttcaaatgctatcttttatgtctccatgatgaaaaaaaaaaaaaaaa

SEQ ID NO: 5174 - protein, 428 aa, Triticum aestivum
  misc_feature: PFam Name: F-box; PFam Description: F-box domain
  misc_feature: GI Number: 50938037; NR Description: receptor-like kinase-like [Oryza sativa (japonica cultivar-group)] >gi|33146479|dbj|BAC79588.1| receptor-like kinase-like [Oryza sativa (japonica cultivar-group)] >gi|50508392|dbj|BAD30392.1|
  misc_feature: GI Number: 34914902; NR Description: B1096D03.14 [Oryza sativa (japonica cultivar-group)] >gi|22535607|dbj|BAC10781.1|
  misc_feature: GI Number: 51090467; NR Description: F-box domain-like [Oryza
MDCPKRSASAGLPEDSLVEILARVPARSVYRSKCVAKAWRDLIEDPLHRKKLPQTLQGFFLIDKETHRQRVCFANLLDRSGPLQIDRNLAFLKESPGIGTLDFSDSCNGLLLFEHKLEAWPYNLLGYVVCNPATKQWVEVPRDGPPLPLYLRQPKRFNYLVFDPSVSSHFHLVQFTWEFVRLVKFEEEELVVGHDDDDDDGEEEEEGDEEEEVSRTSVHVYSSETDKWTHTQSDWSQVQSGRNKHDLEGWRLQGLIPESFCCAVLNSMLHFIISDEGQIAAVDMQGVTRKIIPVPTMAERLHWLEPGCVAQSQGRLHYISQAVDGRLSIWVLEGYDTQEWVLKHSVSFTGLFREKRRTGDTKDYSVVAMHPDGNVVFIVQDWNRKMISYHTDNKLVSVIGTLKNDASDMHVVTYVPCFSESPALPIKH

SEQ ID NO: 5175 - DNA, 1727 bp, Triticum aestivum
  misc_feature (1)..(1727): Ceres cDNA ID no. 22005617
  misc_feature (1)..(1727): Ceres CLONE  ID no. 793727
  misc_feature (1)..(1727): Also known as  Ceres CDNA ID no. 24409358
aagcatacataactgagataactcggaatcttggcaacgaaaccttacaagtcaaaatacatcttcagatcttgtgtgtcattcagtcatggagcccacacccttgtcagtgtgcatctcgctgctctgtatcgcgctgctctgtatcgcgctgctgtgcctcctatggcacaagtcaacgaagccccccgccggtgcgcctgcaccgccacggccgccgggcccaacgccgttcctagtcataggcaacatcccggacctggtccgcggcggcgagctacaccgcgcgctcgctcgcctgtcggtgtcctacggccccgtcatgtcgatgaggctcggcatggcgagcctcgtcgtgctgtcgtccccggctacggcgcacgaggcgctccacaagaaggagggtgccgtctcctcccggtgggtccccgacagcgccagcgtcatgggccacagcggcatctccatggtgtggctcccgagctccagcccgctgtggaagcacctgcgcaccgtggcgagcaccctgctcttcacgtcccggcggctcggcgccagtcgcgccatccaggagcgcaaggcccgggagctcgttgaccacttacacgcgagctccggccgcccggtgcgcgtcgcgctccccgtgttcagcgccgtgctcaacatgctctccagcgttctgttctcggaggacgtcgtcgagctggggtcggtgaccgggcaggagttcatggagctcatcgcagactctgttgcggagacggccaagccgaacatctccgacttcttcccattcctcagctcgctagatctcagccgccgccgccgcgcggtcgccgcgaatctcagcagattctaccagttcttcgacgctgtcatagaccgtcggttgaacagtgccgagaagcccggcgacctgctggagtcgctgctcgagctccccgccaagtcccagctcgagcggccggtgatccgagctctcctaacggatctgttcatcgctgggagccacacgacgacgaccacggtggagtgggcgatggcggagctgctccgcaacccgaccaaaatggcgaaggcgcgcgccgagctaagggaagcgttcggatccggcaacgcagaggaaggtgacctcgccaacctcccgtatctgcaggccgtgatgaaggagacgatgcggctgcatcccccagcgccgctgctgctgccgcacgaggtgtcggagaccggcgtgacactcggcggctgctcggtgccgaagggcgcccgtgttctaatcaacgtgtgggccatcggaagggaccccgaggtgtgggctgagccggaggtgttcatgccggagaggttcttggacagggaggtggacttccgggggagggcgttggagttcataccgttcggatcggggcggagggcgtgccccgggatgccgctggccgtgacggtcgtgccgatggtgttggcatcgctgctccacgagttcgaatggaggctgccggatgggatggcgcccggtgatgtggatctcagcgaccggtttggcgccgcgctagagctcgccgttcctctgagggccgtgccggtttggacgaaaggcgcggaggatttgagtttttcttcgtgacgaactcgttacccgttgactactttttctagatttattttcaccaatgtactaaacatttgacatttgcgttcttattataagtgcaaaaaaaaaaaaaaaa

SEQ ID NO: 5176 - protein, 511 aa, Triticum aestivum
  misc_feature: PFam Name: p450; PFam Description: Cytochrome P450
  misc_feature: GI Number: 51536111; NR Description: putative Cyt-P450 monooxygenase [Oryza sativa (japonica cultivar-group)] >gi|51535860|dbj|BAD37943.1| putative Cyt-P450 monooxygenase [Oryza
  misc_feature: GI Number: 51536110; NR Description: putative Cyt-P450 monooxygenase [Oryza sativa (japonica cultivar-group)] >gi|51535859|dbj|BAD37942.1| putative Cyt-P450 monooxygenase [Oryza
  misc_feature: GI Number: 52076827; NR Description: putative Cyt-P450 monooxygenase [Oryza sativa (japonica cultivar-group)] >gi|52075964|dbj|BAD46138.1| putative Cyt-P450 monooxygenase [Oryza
  misc_feature: GI Number: 50947477; NR Description: Cyt-P450 monooxygenase [Oryza sativa (japonica cultivar-group)] >gi|19849281|gb|AAL99547.1| Cyt-P450 monooxygenase [Oryza sativa]
  misc_feature: GI Number: 50909669; NR Description: putative Cyt-P450 monooxygenase [Oryza sativa (japonica cultivar-group)] >gi|46806732|dbj|BAD17782.1| putative Cyt-P450 monooxygenase [Oryza
MEPTPLSVCISLLCIALLCIALLCLLWHKSTKPPAGAPAPPRPPGPTPFLVIGNIPDLVRGGELHRALARLSVSYGPVMSMRLGMASLVVLSSPATAHEALHKKEGAVSSRWVPDSASVMGHSGISMVWLPSSSPLWKHLRTVASTLLFTSRRLGASRAIQERKARELVDHLHASSGRPVRVALPVFSAVLNMLSSVLFSEDVVELGSVTGQEFMELIADSVAETAKPNISDFFPFLSSLDLSRRRRAVAANLSRFYQFFDAVIDRRLNSAEKPGDLLESLLELPAKSQLERPVIRALLTDLFIAGSHTTTTTVEWAMAELLRNPTKMAKARAELREAFGSGNAEEGDLANLPYLQAVMKETMRLHPPAPLLLPHEVSETGVTLGGCSVPKGARVLINVWAIGRDPEVWAEPEVFMPERFLDREVDFRGRALEFIPFGSGRRACPGMPLAVTVVPMVLASLLHEFEWRLPDGMAPGDVDLSDRFGAALELAVPLRAVPVWTKGAEDLSFSS

SEQ ID NO: 5177 - DNA, 1296 bp, Triticum aestivum
  misc_feature (1)..(1296): Ceres cDNA ID no. 22005618
  misc_feature (1)..(1296): Ceres CLONE  ID no. 797606
  misc_feature (1)..(1296): Also known as  Ceres CDNA ID no. 24410682
agttgtgagataagcagttctgaagactgaaggctcaacgttcttccacctccacctccagctccagctcaggtaaatacgtacgtggggaagggaggcatgtctgcgaaggccggcaagcccctggtccagaccgacgcgggggcgtacatagcttggtctggtgctgaccagccggagctcgcaacggaggggctcgggtgtggccttctcgtgctgaggcccctcggcttcgcgctgccgcattacgctgactccaacaagttcggctacgtcctcagcggctccggggtggctggggtccttccggtcgaggccaaggagagggtcgtccgcctgaaggccggcgacgtcatcgccgtgcgcactggggacgtatcgtggtggtacaacgacaacgacaacgaaggcagcgctgatgacttgtccatcttgttcataggcgacacggcgcgcgccgtcagccccggggacatctcatacttcttcctcgccggcggcaacagcgtcctgagcggcttcgacgcgggcctcctcaccatggcgtggcctggggtcacggaggagcaggcggccaccgcgttccggagccagccggccgtcctcctcaccaggctgagcgcgaagctgcccggcgtatgcccgcgagagcacgacaggaaagggctcgtcgtgaacgccggccacgtcgctgcagggaccctgaagatgctcaccgcgtcggatctggacgcgctgggcggcttcggattcagcgcggtgctcgggcggctcgagcccggcgccgcgagggcgccgtgggtgctccgcgagggcgcggcgcaggcggtgtacgtggcccgcgggagcgcgcgcgtccaggtctcgtccgccgtgggcggcgacacgctgctgctggacgaggatatcgctgcggggagcttgttcgtcgtgccgcggttcgccgtggcgctcgtcgccgccggcgccgatggagtggagtgggtctcgctgatcaagagcgccaggccggcggtggagcacctgatcggggagggctcgattttcggcggcctgactccacaggtggtgcaggcatcgctgaaggtggcgccggagctggtgaagctgctctgagcggtggtgaccgagtctcggtgcacgtgtgcgtttactttctgtcgtctgtgtgaaatacgctttctccaacaagaagatcgtcgtgcacgcttgtatgctgcggcgtcgtgtatcactcggtctgtgattatacgctgtacctgtccttttatttcttctccaaaaaaaaaaaaaaaa

SEQ ID NO: 5178 - protein, 338 aa, Triticum aestivum
  misc_feature: PFam Name: Cupin_1; PFam Description: Cupin
  misc_feature: GI Number: 24111337; NR Description: At1g07750/F24B9_13 [Arabidopsis thaliana] >gi|12248029|gb|AAG50106.1| putative globulin protein [Arabidopsis thaliana] >gi|8439891|gb|AAF75077.1| Contains similarity to 12S seed
  misc_feature: GI Number: 21593610; NR Description: globulin-like protein
  misc_feature: GI Number: 28950668; NR Description: legumin-like protein
  misc_feature: GI Number: 28950670; NR Description: legumin-like protein
  misc_feature: GI Number: 4580389; NR Description: legumin-like protein [Arabidopsis thaliana] >gi|25408007|pir||H84687 legumin-like protein [imported] - Arabidopsis thaliana >gi|15226926|ref|NP_180436.1| cupin family protein [Arabidopsis
MSAKAGKPLVQTDAGAYIAWSGADQPELATEGLGCGLLVLRPLGFALPHYADSNKFGYVLSGSGVAGVLPVEAKERVVRLKAGDVIAVRTGDVSWWYNDNDNEGSADDLSILFIGDTARAVSPGDISYFFLAGGNSVLSGFDAGLLTMAWPGVTEEQAATAFRSQPAVLLTRLSAKLPGVCPREHDRKGLVVNAGHVAAGTLKMLTASDLDALGGFGFSAVLGRLEPGAARAPWVLREGAAQAVYVARGSARVQVSSAVGGDTLLLDEDIAAGSLFVVPRFAVALVAAGADGVEWVSLIKSARPAVEHLIGEGSIFGGLTPQVVQASLKVAPELVKLL

SEQ ID NO: 5179 - DNA, 1798 bp, Triticum aestivum
  misc_feature (1)..(1798): Ceres cDNA ID no. 22005620
  misc_feature (1)..(1798): Ceres CLONE  ID no. 817115
  misc_feature (1)..(1798): Also known as  Ceres CDNA ID no. 25401162
aacgagccccctcctcctgctttgttccccgaagggatcgagagagttgccgccgccttgtcacctcccgcgcctctcgacccccgcctcctctgcacgcatctcaccggagcaagctcaccccgatccagtcgctgccggtgaacagcggcagcaaccgaggcccgctgcgtttccccgctatttccttctcatccttccccttccccctgtctctccctcacatctctctctctctgcaggagactgccgtcgcgccctctgccatggagctcgcctccatagtcagcaccgcccgagggccccaccgtccccaccgccgtgttaggaggctcatggaggaggataacaagaaggcaatgcgcaaggcgcggcgggagtataacgatgctgtgagagggttggctgccttctgtaagaagagagataaaagggtggttgacatggcactgcggaagaaggcagaggaagagaaaaagaagaaggaagagatggagcgaaagaaggccgaggagaagaagaagaaggagcgggcaatggcgtatcaagagcctgagtgggcgagggtggacgacatcgagttagcctttgaggaagaggatgatgaggagacgagggaaaaggccaaggaggagctgtactgtgtggcctgtaataagaagttcaagtcggagaagcagtggaagaaccatgagcagtctaggaagcataaggataaggtggctgatctgaggatggcctttaaggaggaggaggcggctctaaaggaagccgaggaggaggcaggaggtgagtgggaagaagttgatgtggggttcgactttaagcctgctaacgagtccgaggagagtgattggtcagatgctgcagaagagttggctgaggagttggacgagggcttggaggtggcggatcaagacaatggtaataaggacttcaataatggggagcaggaggttggttcatatgatgagacgagtgtgttggaggcgatgttgtcaagctgtaagaacaagaaaagtggctatgtggttcctcaagaggaagctccttctgttcttacagaggatgataacagtgaagatagaaattctgaagttaagagtgtcaagaagaaaggacgccggaggcgggcatcaaagaagggacaagatgaaggtagttatgctgatagtggacatggtatgaagaatgatgttccaaatgaggaatctgtgcatgataatgatgaaaatgatgctgatgataaggcggaaggtccaccctcttctaatgatgatggcacatcagcaagcgttggaggccaacagaacgaaaagactgacaatcctaaaaagaataaaaagaacaagaaaggcgcagagaagaaaacaactgtttctgctgacgtaaagatcacatcaaagggaaagaagcaaaaggaggtctcgagggcacgcaatgattgtgaaacatgtggagatactttcgagtcaaggagcaagttgttttctcatttggaagaaacaggtcatgctgtgatcaaggcacgacagaaaaagcgttaaggcgaggaataattagatatttttgtttgagcattctctctcccagttccagttggtggttgtcgatatcagtgctgtgccattcttgtaacttgtcttgttttgggcgcctccatgcacatgaaggttttgacctgaaatcaataccccttccccttgtcttgtttgtagggaggtgctgtctttggtttaacacatcaacaaacagagtgaaaacaccatatcatccagggcgaaaaaaaaaaaaaaaa

SEQ ID NO: 5180 - protein, 426 aa, Triticum aestivum
  misc_feature: PFam Name: Caldesmon; PFam Description: Caldesmon
  misc_feature: PFam Name: TolA; PFam Description: TolA protein
  misc_feature: PFam Name: E-MAP-115; PFam Description: E-MAP-115 family
  misc_feature: PFam Name: Plasmodium_HRP; PFam Description: Plasmodium
  misc_feature: PFam Name: zf-C2H2; PFam Description: Zinc finger, C2H2 type
  misc_feature: GI Number: 12324903; NR Description: putative heat shock protein; 32627-30541 [Arabidopsis thaliana] gi|25406329|pir||H96770 protein heat shock protein F1O17.8 [imported] - Arabidopsis
  misc_feature: GI Number: 48103935; NR Description: similar to CG2790-PA
  misc_feature: GI Number: 66852706; NR Description: C2H2 finger domain
  misc_feature: GI Number: 46227273; NR Description: DNAj domain protein
  misc_feature: GI Number: 23613492; NR Description: P. falciparum RESA-like protein with DnaJ domain [Plasmodium falciparum 3D7] gi|23476994|emb|CAD48951.1| P. falciparum RESA-like protein with
MELASIVSTARGPHRPHRRVRRLMEEDNKKAMRKARREYNDAVRGLAAFCKKRDKRVVDMALRKKAEEEKKKKEEMERKKAEEKKKKERAMAYQEPEWARVDDIELAFEEEDDEETREKAKEELYCVACNKKFKSEKQWKNHEQSRKHKDKVADLRMAFKEEEAALKEAEEEAGGEWEEVDVGFDFKPANESEESDWSDAAEELAEELDEGLEVADQDNGNKDFNNGEQEVGSYDETSVLEAMLSSCKNKKSGYVVPQEEAPSVLTEDDNSEDRNSEVKSVKKKGRRRRASKKGQDEGSYADSGHGMKNDVPNEESVHDNDENDADDKAEGPPSSNDDGTSASVGGQQNEKTDNPKKNKKNKKGAEKKTTVSADVKITSKGKKQKEVSRARNDCETCGDTFESRSKLFSHLEETGHAVIKARQKKR

SEQ ID NO: 5181 - DNA, 1438 bp, Triticum aestivum
  misc_feature (1)..(1438): Ceres cDNA ID no. 22005621
  misc_feature (1)..(1438): Ceres CLONE  ID no. 821276
  misc_feature (1)..(1438): Also known as  Ceres CDNA ID no. 24408423
acaggctcacacccacagcccggagccactactttccttccacatccctcgtgccgtttgcacgtacgctctctcccgttttctcctccctcggctccggtggacacgtcttaaccggagcaagctacctagcgcgccgcggtcggccattgtctcggcgactggtcagtaactgatctgcagctacctagagagtagtgtgagtgtgtgacggagctaggcggcctgcagcaacgcacagctacatatacaggcagctgggttggcgcggttctcggaaaagaacaacactccaacaagaaggaaaggcttttagctaggcacgagaggatggtgaacacggcgtcggccggcgtgaacaaggcggcggcggcggcggcgcaggggggtcaccgggcgctgccgctggcgtcgctgaaccacatctctgtggtgtgccggtcgctggagagctcgctcagcttctaccgcgacgtcctcggcttcatccagatccgccgcccgggctccttcgacttcgacggcgcatggctgttcaacttcgggatcggcgtgcacctgctgcaggcggaggacccggagagcctgccgcccaagaaggcggagatcaaccccaaggataatcacatctccttcaccacgtgcgagagcatggaggcggtgcagcggcggctcaaggagctgggcatccggtacgtgcagcggcgggtggaggagggcggcatccacgtcgaccagatcttcttccacgaccccgacggcttcatgatcgaggtctgcacctgcgacaacctccccgtcatcccgctcgtcacgcacctcgacgccgccgccgcctgcgcgccacctgcggtcgtcgcgcccagctgcaagagggtctccaaccagcaccagcagcagctcagcaccatcgtcaccgcggccgtgcccgaagtcccgccaacggcggccacggcgcaacagcagtccgtcggcggcggctgcgtcggcgaggtcgtcgacccggcggccagcatgtccgccagcgccatgatgacatgctcggagcacgcctgcatgcaggtgtaatcattcattcgcctgttggcttgcgaggacgcgacgttttgacggactgtcgagctcgagctcgagccagccatcgtttatttctgcggtttcttttgcccgtaattagctgtgtttagcaccggccggttttcttttcttcttcgaatatattcgagtacgtacctaaattgtattcagctgcatgcgggtaggtctggccatcgcttacgctgacgaccgaggatccattgatctctcagccagctgggggtaggtagctagtggcttgctctgcatgcatgccagtgtatgttgcacatatatatgtacgctgtgatctattctgtgtattcaatgtaatgatcattcagtaaaaaaaaaaaaaaaa

SEQ ID NO: 5182 - protein, 245 aa, Triticum aestivum
  misc_feature: PFam Name: Glyoxalase; PFam Description:
  misc_feature: PFam Name: Cupin_1; PFam Description: Cupin
  misc_feature: PFam Name: MSA_2; PFam Description: Merozoite Surface
  misc_feature: PFam Name: 7tm_1; PFam Description: 7 transmembrane receptor
  misc_feature: GI Number: 34910246; NR Description: OSJNBa0089K24.9 [Oryza sativa (japonica cultivar-group)] >gi|15128224|dbj|BAB62552.1|
  misc_feature: GI Number: 21554257; NR Description: unknown [Arabidopsis thaliana] >gi|18412683|ref|NP_565231.1| lactoylglutathione lyase
  misc_feature: GI Number: 16974407; NR Description: At2g28420/T1B3.6 [Arabidopsis thaliana] >gi|15529260|gb|AAK97724.1| At2g28420/T1B3.6
  misc_feature: GI Number: 50939739; NR Description: glyoxalase family-like protein [Oryza sativa (japonica cultivar-group)] >gi|34395261|dbj|BAC83945.1| glyoxalase family-like protein [Oryza
  misc_feature: GI Number: 5420387; NR Description: proteophosphoglycan
MVNTASAGVNKAAAAAAQGGHRALPLASLNHISVVCRSLESSLSFYRDVLGFIQIRRPGSFDFDGAWLFNFGIGVHLLQAEDPESLPPKKAEINPKDNHISFTTCESMEAVQRRLKELGIRYVQRRVEEGGIHVDQIFFHDPDGFMIEVCTCDNLPVIPLVTHLDAAAACAPPAVVAPSCKRVSNQHQQQLSTIVTAAVPEVPPTAATAQQQSVGGGCVGEVVDPAASMSASAMMTCSEHACMQV

SEQ ID NO: 5183 - DNA, 1671 bp, Triticum aestivum
  misc_feature (1)..(1671): Ceres cDNA ID no. 22005623
  misc_feature (1)..(1671): Ceres CLONE  ID no. 825097
  misc_feature (1)..(1671): Also known as  Ceres CDNA ID no. 24409539
acgcgtgatcggagccaagattgaacaatctaccgcgcggacttcccgagaatcgacatggtctgcgacgagagcaaggcattgcagcgcaagaaggtatgcgtgatcggagctgggatggccgggctcgcgtcagcccgcgagctgcgccgggagggccacgacgtgacggtgctggagcagaacgccgacgtgggcgggcagtggctgtacgaccctaggggcggcggcgccgacgacccgctcggcgccgcggagccggtgaaggtgcacagcagcttgtacgcgtccctccgcgtcatcagcgccagggagaacatgggcttcaccgacttccactttgcgcccaaggctggccgtgacggccgccgcttcccgggccacggcgaggtgcagctgtaccttaaggacttctgcgacgcgttcgggctcatggaggcggtccggctcaacacgcgtgtcctgcgcgtcgccatggcggtggcaccgacgcggcagtggatggtgaggtccgtacacgagggcacggaggaggaggaggaggaggtattcgacgccgttgtcgtggccaacggccactactcgcagccgaggctgccaagcatccagggcatggaggcgtggagggggaggcaaatccacagccactcgtacagggtgccggagccgttccgcggcgacgtggtggtggtggtcgggtgcggggcgagcggcaaggacatcgccatggaggtccgcggggtcgccaaggaggtgcacctcgtggccaagtccatggaggaggtcaccccagggctcgccaaagtgctcgccaagcatagcgccaacctgcacctgcaactgcacgtggagcgtctgtgcgaggacgggcgggtggtgttcggcggcggcggctccggcgtcctcgccgacaccatcatctactgcacagggtacaattactctttcccgttcctggacacggcgggggcggtcaccgtcgaggacaaccgcgtcggcccgctgttcgagcacgtgttcccgccgtcgctggcgccgtcgctctccttcgtcggcatacccataaaggtgtttgcgccatggttcttcgaggctcaggcgaaatgggtggcgcaggtgctgtccgggaggaggacgttgccgccggagcaggagatgatgcggtccgtggaggagtattaccgtgccagggagatcgccggcgtgcccaagaagtacatccacgacgtctgcttgtctgagaccatgcccacgtacatggatgagttcggaagcaagtactgtgacttccctcgcgtggagagatggcatcacgagttggttgtgtcgttgtttgccaacatgaacgacaatctcgagaccttccgcgacgactaccatgacagcgactccatccgcaagggtgtggaagagtggcacttgtcggcccaacagacccaagctgctcctgctgctaaaaagatgtcgcttggtctttcacgaacaagcacagtggtctgtgcacacccttcgtgacatggtgtgccttccaggattccgcagtaatcatcgatatgttttactcgtttttgtacttatataaatcatacgcccagaaatgctacagataacttataaatgcatttgtgtcatttgtcatttgtagtaaaaaaaacaaaaaaaaaaaaaaaa

SEQ ID NO: 5184 - protein, 485 aa, Triticum aestivum
  misc_feature: PFam Name: FMO-like; PFam Description: Flavin-binding
  misc_feature: PFam Name: Pyr_redox; PFam Description: Pyridine
  misc_feature: PFam Name: DAO; PFam Description: FAD dependent oxidoreductase
  misc_feature: PFam Name: Pyr_redox_2; PFam Description: Pyridine
  misc_feature: PFam Name: Amino_oxidase; PFam Description: Flavin
  misc_feature: GI Number: 34915254; NR Description: putative dimethylaniline monooxygenase [Oryza sativa (japonica cultivar-group)] >gi|22831292|dbj|BAC16146.1| putative dimethylaniline monooxygenase [Oryza sativa (japonica cultivar-group)]
  misc_feature: GI Number: 58737201; NR Description: putative flavin-containing monooxygenase FMO-1 [Oryza sativa (japonica
  misc_feature: GI Number: 53791948; NR Description: putative flavin-containing monooxygenase FMO-2 [Oryza sativa (japonica
  misc_feature: GI Number: 14091824; NR Description: Putative dimethylaniline
  misc_feature: GI Number: 10176714; NR Description: dimethylaniline monooxygenase-like protein [Arabidopsis thaliana] >gi|15240866|ref|NP_196397.1| flavin-containing monooxygenase
MVCDESKALQRKKVCVIGAGMAGLASARELRREGHDVTVLEQNADVGGQWLYDPRGGGADDPLGAAEPVKVHSSLYASLRVISARENMGFTDFHFAPKAGRDGRRFPGHGEVQLYLKDFCDAFGLMEAVRLNTRVLRVAMAVAPTRQWMVRSVHEGTEEEEEEVFDAVVVANGHYSQPRLPSIQGMEAWRGRQIHSHSYRVPEPFRGDVVVVVGCGASGKDIAMEVRGVAKEVHLVAKSMEEVTPGLAKVLAKHSANLHLQLHVERLCEDGRVVFGGGGSGVLADTIIYCTGYNYSFPFLDTAGAVTVEDNRVGPLFEHVFPPSLAPSLSFVGIPIKVFAPWFFEAQAKWVAQVLSGRRTLPPEQEMMRSVEEYYRAREIAGVPKKYIHDVCLSETMPTYMDEFGSKYCDFPRVERWHHELVVSLFANMNDNLETFRDDYHDSDSIRKGVEEWHLSAQQTQAAPAAKKMSLGLSRTSTVVCAHPS

SEQ ID NO: 5185 - DNA, 1552 bp, Triticum aestivum
  misc_feature (1)..(1552): Ceres cDNA ID no. 22005624
  misc_feature (1)..(1552): Ceres CLONE  ID no. 825646
  misc_feature (1)..(1552): Also known as  Ceres CDNA ID no. 24408792
atatccctcttcgtcagttcgtctacacggaagcagcaaaagcttgaaagccacttcgatcgccttccaaacccagcaaatcaaacgaagctacatcaccgaaccagctgcagtccaaagcatggcggcactccagccccagcgcctcttcttggcccagtcttcctttctcccatccacctccgccgcgcggccgcggccacggccacgccggaccggcgccgcgacctgccgcgccgccctgcgcgtgccttccggcattcacatggcgcaggacaacctcagcctcaagcttgactggatcccggcctctccgtcagcggacgccgacggcggttccgtgtccatcgagaagctccgcgccatcgcggacgcggcggcggaccgggccgagatgcacgacatcatcggcaggcagcgtgacaactggaaccacctgctgctccactccaccaactccctcacgctcgccgcctccgtcatggccgcgctcgcgcccgccgcgcccggcgtggtcgcgctcaaggcctccgcgggggtcctcctggcctccgcggccgtcaccatggcggccgtcaacaagatccagccctcgcagctcgccgaggagcagcgcaacgccacgcggctgtggagggagctggagcgcgacgtccgcgccgcgctcgcggtcgacgcgtccacgaccacaaccaaggacgacgtgcaggaggccatggaccgggtgctcgcgctcgacgccgcctacccgctgccgctgctccccggcatgctcgagaagttccccaaggccgtccagcccgcgcgctggtggccgcgccgccgcgccgcgcagcccaagaggtcaaggagcttcgcccgtcgtggctccgtcgcggccggcaacaacggctggacccaggatctcgagcaagagatgcgaggcatcctcagggtcatcaaggccaaggacgagcaggagttcctgacggtgggcaagctggtgctgaacctgaacaggggcctcgccgtggccggcccggcgctggccggcacggcggcgctcgcgtcggtgttcatcggctccggcgaggccggcacgtgggcgtctggcgcggccgtccttggcggggcgctggcagcggccgtgaacacgatggagcacggcgggcagatgggcatgctcttcgagctgctccgcaactgtgccgggttctaccgcaagatccaggaggacatcgaggccaacctggacgagcccgacgtggagcggagggaggggggcgaggtgttcgcgaccaaggtggccctgaagctcggccggagtctgtcggacctcaagcagttcaggaagatggcgtcgccgtccatcagagatgaggacatcgaggagtttgccggcaaactcttctagtcaacccactcaatcactcactcactcacactagcatagctgacagatgaactcgtcaaatctgcatagcgatccatgaattattttgtaaaggtagaaactgaaatgacaatttttcgattcattctttcattttcgatctcaaaaaaaaaaaaaaaa

SEQ ID NO: 5186 - protein, 423 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: Atrophin-1; PFam Description: Atrophin-1 family
  misc_feature: PFam Name: Extensin_2; PFam Description: Extensin-like region
  misc_feature: PFam Name: Pkinase; PFam Description: Protein kinase domain
  misc_feature: GI Number: 50906499; NR Description: F-box family protein-like [Oryza sativa (japonica cultivar-group)] >gi|46805653|dbj|BAD17072.1| F-box family protein-like [Oryza sativa (japonica cultivar-group)] >gi|49388524|dbj|BAD25646.1|
  misc_feature: GI Number: 50906503; NR Description: F-box-like [Oryza sativa (japonica cultivar-group)] >gi|49388526|dbj|BAD25648.1| F-box-like
  misc_feature: GI Number: 50906509; NR Description: F-box-like [Oryza sativa (japonica cultivar-group)] >gi|49388529|dbj|BAD25651.1| F-box-like
  misc_feature: GI Number: 50908461; NR Description: F-box family protein-like [Oryza sativa (japonica cultivar-group)] >gi|47847617|dbj|BAD22103.1| F-box family protein-like [Oryza sativa (japonica cultivar-group)] >gi|47848064|dbj|BAD21848.1|
  misc_feature: GI Number: 66779508; NR Description: Aspartate/glutamate/uridylate kinase [Anaeromyxobacter dehalogenans 2CP-C] >gi|66854587|ref|ZP_00398667.1| Aspartate/glutamate/uridylate kinase [Anaeromyxobacter
MAALQPQRLFLAQSSFLPSTSAARPRPRPRRTGAATCRAALRVPSGIHMAQDNLSLKLDWIPASPSADADGGSVSIEKLRAIADAAADRAEMHDIIGRQRDNWNHLLLHSTNSLTLAASVMAALAPAAPGVVALKASAGVLLASAAVTMAAVNKIQPSQLAEEQRNATRLWRELERDVRAALAVDASTTTTKDDVQEAMDRVLALDAAYPLPLLPGMLEKFPKAVQPARWWPRRRAAQPKRSRSFARRGSVAAGNNGWTQDLEQEMRGILRVIKAKDEQEFLTVGKLVLNLNRGLAVAGPALAGTAALASVFIGSGEAGTWASGAAVLGGALAAAVNTMEHGGQMGMLFELLRNCAGFYRKIQEDIEANLDEPDVERREGGEVFATKVALKLGRSLSDLKQFRKMASPSIRDEDIEEFAGKLF

SEQ ID NO: 5187 - DNA, 1387 bp, Triticum aestivum
  misc_feature (1)..(1387): Ceres cDNA ID no. 22005625
  misc_feature (1)..(1387): Ceres CLONE  ID no. 825974
  misc_feature (1)..(1387): Also known as  Ceres CDNA ID no. 24409323
ctgatccctacacgggctcgtctcgcaccgcgtacccctggcgccatgcaatccctcgggcatcccacctctgcgtcggaactgagggcgctcgcctggacgacgctccttgttccgatgtgcgcggtctacgcgcgctccgcctgccgccgcctccgtccgggctggccccgcctcgccgcaatcctcccgacgctccccgtcttcatctacctgccgtgcttgttcaactcctaccacctccgcctcttctcaaccttcttccacacctggctcgccgccaacaagctcgtcctcctcgcgttcgacctcggcccgctcaagccatccctgcccctcctcccatttctcctctgcaccggcctgcccatcaggctccgcgaaggtccacagcctaccagccattctgcgtcgccgggaccgtccgtcgccgatttccttgtcccctgcggccgcagcgttctcttcctcaccggcctcgccctgctctttccacacactggttcgctccctctctacgtcgtccactacctctactgcgcacagatctttctcacgctcgatctcgtcttctcttccgtcggcctcgtcgccgctgccgtgctgggctcggccatggagaggcagttcagagcgccgctcgtcgtcgcgtcggttaacgacttctggggccggcagtggaacctgatggcggtggacctcctccgagcgtcggcgtacaagccggtaagagaccggtggggccgggacgccggcgtgctggccgcgttcctcatgtcgggcgtcctccacgagctgctctactggtacatgacgctggagccgcccacgggcgagatgctgctcttcttcacgctccaggccgctttccacgtcgccgagcggtgggcgagggttgccgggctgtggcgaccgcccaaggcggcggcgtaccttattggcaccacctttatggtcgtcaccatatcggagctcttcttcgggccgttcatcagagccggcacagacgtgcgtatgattcaggaggccgccgacgcggtggggttggttagggccgtcgctaagcgtctcatcgtccgtctatttggggatgcttcgagttagagacagaagagtaacgttcagctgtcaggatatttcgggcttttcatactaggtataatctgtggccgctatgcttgcttggtttcttctattttcctgattctacttctgccaaacaagttaaggaaaggtttagtattgttgttagtgagggttcgacgaacattagggagattgaagatgaattgaacgtgtactgtactttatttctccctggagatgtaacctcttcctattggtccaaataagtatgtcatgcatttcttcaaaaaaaaaaaaaaaa

SEQ ID NO: 5188 - protein, 352 aa, Triticum aestivum
  misc_feature: PFam Name: MBOAT; PFam Description: MBOAT family
  misc_feature: PFam Name: Extensin_2; PFam Description: Extensin-like region
  misc_feature: GI Number: 34911838; NR Description: wax synthase-like protein [Oryza sativa (japonica cultivar-group)] >gi|20146429|dbj|BAB89209.1| wax synthase-like protein [Oryza
  misc_feature: GI Number: 50938097; NR Description: putative wax synthase isoform protein [Oryza sativa (japonica cultivar-group)] >gi|28812087|dbj|BAC65039.1| putative wax synthase isoform protein [Oryza sativa (japonica cultivar-group)] [Oryza sativa
  misc_feature: GI Number: 50907895; NR Description: putative wax synthase [Oryza sativa (japonica cultivar-group)] >gi|47497822|dbj|BAD19919.1| putative wax synthase [Oryza sativa
  misc_feature: GI Number: 38347115; NR Description: OSJNBa0009K15.12 [Oryza
  misc_feature: GI Number: 58532043; NR Description: OSJNBa0009K15.16 [Oryza
MQSLGHPTSASELRALAWTTLLVPMCAVYARSACRRLRPGWPRLAAILPTLPVFIYLPCLFNSYHLRLFSTFFHTWLAANKLVLLAFDLGPLKPSLPLLPFLLCTGLPIRLREGPQPTSHSASPGPSVADFLVPCGRSVLFLTGLALLFPHTGSLPLYVVHYLYCAQIFLTLDLVFSSVGLVAAAVLGSAMERQFRAPLVVASVNDFWGRQWNLMAVDLLRASAYKPVRDRWGRDAGVLAAFLMSGVLHELLYWYMTLEPPTGEMLLFFTLQAAFHVAERWARVAGLWRPPKAAAYLIGTTFMVVTISELFFGPFIRAGTDVRMIQEAADAVGLVRAVAKRLIVRLFGDASS

SEQ ID NO: 5189 - DNA, 1408 bp, Triticum aestivum
  misc_feature (1)..(1408): Ceres cDNA ID no. 22005626
  misc_feature (1)..(1408): Ceres CLONE  ID no. 826419
  misc_feature (1)..(1408): Also known as  Ceres CDNA ID no. 24434399
ctaaatccccagtccccaattccccatcgcgcgagcgcgcgtgccgccactaccatcgacggctagccaccaccgcacgtcgccgccacgaccgtcgtcactgacctgcaaaggaagcggaggccgccgccgagaggcaaaacctacagcccgaaccctagcgagctccatccatggcggacgcccccgcgcaacccgcaccggccgccgcggccgccgccgggaacccccacaagcgcaagaacaaggggaagggcaaccccaacaagaagaacaagaagctgaagggccccgacgacgccacccgccgccgccacaagccgagcgccaagttcctcaagctgctcgagaagcgcgcccgcgactacaactccgacgacgacgacgacgacgccccccaagtccgaccacgaaggtcacagccacggccgccgccgaagcaacgtgatgctgctcccgatggcgacgacgacctcaaagaggccccctcgtccgaggaggaggcctccagctccggcggggagtccgacggagaaaaggctgtcaccatgttccaggaaggctgcagggctttccaggccgccttcaccaagatcatggagaagaagctcgccgacaacccactgggtccaattctgtcagcggacaagaaattggtcgccgccaagttggccgaggaggcggacgagcacaagtccaagggagaggcccgcaaggagaagcgccttgctgcgcagaagggtcataaaatacctgagaatgctattgacaacaaagaaaagatgcttatcaaggttgcaacccaaggagttgtcaggttgttcaatgaggtgagcaagcgacagactaggaaaggtttgaatccatcaagaagtaaagatgtcaaatctttggcaaaacactctgtaccatctagcgaaggacaacaaggccagggatcttccaagttctcaaagaatattggcaaaggtgaagatgagccagggtgggcccctctacgtgacacatacatgcttggttccaaattgaaggactgggataaagcgcaggattctgatgtggctaaaccgagtgaggtccctttggacaacttttctgatgatgaataggaaacaaaatctatttgcatggttggctgaggggctacattttgaaggggggaatggagggtggttgatgcttttggatgcatccaagagcgcaagattttggagaggggaagaatggcgtctctgatgtggttttcggttactaggtttcattgcatgcatccaggagcgcaagatttctacatgcaaaccttgtagttttagtttctcttcatccttgtatcacaacaaaattcttgcagaattgttgtcacagcttaatgagtataattgttttgcccacaaaaaaaaaaaaaaaa

SEQ ID NO: 5190 - protein, 311 aa, Triticum aestivum
  misc_feature: PFam Name: Mucin; PFam Description: Mucin-like glycoprotein
  misc_feature: GI Number: 62734214; NR Description: transposon protein,
  misc_feature: GI Number: 62948087; NR Description: Unknown (protein for
  misc_feature: GI Number: 13559026; NR Description: bG174L6.2 (MSF:
  misc_feature: GI Number: 5031925; NR Description: proteoglycan 4; megakaryocyte stimulating factor; articular superficial zone protein; Jacobs camptodactyly-arthropathy-pericarditis syndrome gene; camptodactyly, arthropathy, coxa vara, pericarditis syndrome
  misc_feature: GI Number: 55665385; NR Description: serine\/arginine repetitive matrix 1 [Homo sapiens] gi|55959944|emb|CAI14683.1|
MADAPAQPAPAAAAAAGNPHKRKNKGKGNPNKKNKKLKGPDDATRRRHKPSAKFLKLLEKRARDYNSDDDDDDAPQVRPRRSQPRPPPKQRDAAPDGDDDLKEAPSSEEEASSSGGESDGEKAVTMFQEGCRAFQAAFTKIMEKKLADNPLGPILSADKKLVAAKLAEEADEHKSKGEARKEKRLAAQKGHKIPENAIDNKEKMLIKVATQGVVRLFNEVSKRQTRKGLNPSRSKDVKSLAKHSVPSSEGQQGQGSSKFSKNIGKGEDEPGWAPLRDTYMLGSKLKDWDKAQDSDVAKPSEVPLDNFSDDE

SEQ ID NO: 5191 - DNA, 1551 bp, Triticum aestivum
  misc_feature (1)..(1551): Ceres cDNA ID no. 22005628
  misc_feature (1)..(1551): Ceres CLONE  ID no. 827432
  misc_feature (1)..(1551): Also known as  Ceres CDNA ID no. 24407018
aaccggatccaaatcgccgcccgccatggatttcctcttcaactcgctcgcggcgcccgacccggcctccccgccgccggagccggaggccgccgcggggtcctcctcctcctcgtccacgcccgccggctccggcgacgggggcgggtggggccgcttcggcgggctgctcaagaccctcacctcccagtccgagaccgtgctggacgcctaccgccgcgacctcgccgagttcagcaccggcctgcgccgcgagaccgacgcgctccgcgaggccgccgcccaggcggcccgggacctcccctcctcggccctcgcgctcgacggcctcgccgacatcgtcgcccagggcaagggcgccatcgcccaggtcgccgccaccgcctccgccgccgcctcagcctccccggccgcgccctccgacgccgactccgaccccggccccgcctcgggccacctgaggtactacagccgcttcgaggcgcagctgcgcgcgctccagtcggatccggccaccttcaccgccgatcccgaggacgccgaggacttcgcggcctggggcgcggggtttagcctccaggagaggcaagacgagatcgaggcgctctgctacgagagcgatgccgtggaagggatggttgacaggctcgtccccgacgccgtggagggcgacgtgttctgggccaggtacttttaccgcgtccacaagctcaagcagcaggaggacgccagggccaagctcgtcaagcgggtcatcgcgcaggaggaagaggaggatttgagctgggaggtggatgacgaggttgaggaggagccagcaaaagaggaggtgatcaagcaagcaccgatcaaagaagaaccgaaacctgaagtacaggaaagagaaaatgagaaactggaggttgaaggcagagtcaatgcagttgaagaggccggtgctctggataaggaacagaagaatgccgattcaccgcagccggaagttttcggtagctctatggtggtagtcgacaaggaggagaaggaagatgcatcgaaattgaatgttgaagagtcaagtgacaagaaatctgctgctgaggaaccacattctagcactggagatgctgaggtgaaagaagggacaaagaatgagacaagtgactcgagcaaggatagcgattactccatggtgtctagacagcgaacagcgaccaaggaggatcttgaatgggacgagattgaggatcttggggagcatgaggagaagaaggggagcgctcatggctcaagctctgctccaaaggaggagctacgtaagaggctcagtgttgcagaagacgacgaggatttgagttgggacattgaggatgacgatgataaggcctgaaaaaccattctggtatggtagtgtcgattgtattgtctacattttttatataccattacttgtgcaagatactatcatgtgaccaataaacattggtttagctgcgctgcttatgttatggatacgtgtgtaaactcaagtttgatgttataaagtggcatttggcaaaaaaaaaaaaaaaa

SEQ ID NO: 5192 - protein, 447 aa, Triticum aestivum
  misc_feature: PFam Name: BSD; PFam Description: BSD domain
  misc_feature: PFam Name: Pyr_redox_2; PFam Description: Pyridine
  misc_feature: PFam Name: FH2; PFam Description: Formin Homology 2 Domain
  misc_feature: PFam Name: LMBR1; PFam Description: LMBR1-like membrane protein
  misc_feature: PFam Name: GATase_2; PFam Description: Glutamine
  misc_feature: GI Number: 18413928; NR Description: BSD domain-containing
  misc_feature: GI Number: 21553778; NR Description: unknown [Arabidopsis thaliana]
  misc_feature: GI Number: 6523547; NR Description: hydroxyproline-rich
  misc_feature: GI Number: 48735128; NR Description: MGC80315 protein
  misc_feature: GI Number: 60688540; NR Description: Unknown (protein for
MDFLFNSLAAPDPASPPPEPEAAAGSSSSSSTPAGSGDGGGWGRFGGLLKTLTSQSETVLDAYRRDLAEFSTGLRRETDALREAAAQAARDLPSSALALDGLADIVAQGKGAIAQVAATASAAASASPAAPSDADSDPGPASGHLRYYSRFEAQLRALQSDPATFTADPEDAEDFAAWGAGFSLQERQDEIEALCYESDAVEGMVDRLVPDAVEGDVFWARYFYRVHKLKQQEDARAKLVKRVIAQEEEEDLSWEVDDEVEEEPAKEEVIKQAPIKEEPKPEVQERENEKLEVEGRVNAVEEAGALDKEQKNADSPQPEVFGSSMVVVDKEEKEDASKLNVEESSDKKSAAEEPHSSTGDAEVKEGTKNETSDSSKDSDYSMVSRQRTATKEDLEWDEIEDLGEHEEKKGSAHGSSSAPKEELRKRLSVAEDDEDLSWDIEDDDDKA

SEQ ID NO: 5193 - DNA, 1766 bp, Triticum aestivum
  misc_feature (1)..(1766): Ceres cDNA ID no. 22005629
  misc_feature (1)..(1766): Ceres CLONE  ID no. 827728
  misc_feature (1)..(1766): Also known as  Ceres CDNA ID no. 24408409
cccacccaccaagacgaagacaggggaaaagttggaaagcaaccagcagccctgttcctccctccctccctccctcccgttgctcataaaaccctaacgcagtggcgcgcaccagccgcccatgccctttcagttgcatctcctcccgtcccgcattggcctcttctcgtcgatctccgccatgtccagctcgcggcgcgcctccaggctcacccgcgcatcccgcccggagctcagcccagctgaaagtgcaagggaagtgaagcgtgaacccggtgtttcttttgactactccaagtctgaaatgaattccgtcaagaggaaaaggctgaaccgtgtgcttgaagtaaaggaggagcttcctaagaagcaggttggtattgttcctgacatcgaagaatttcgatatgtgaagaccggggcaaaaatgtcagtaactgcaaagagggtaccagcatcatcaaataagaacagttcaccaggtgtaaaggaagtgaagtgtgaacccagtgtttcttttgactactccaagtctgaaatgaattccgtggagaggaaaaggctgaaccgtgtgcttgaagtaaatgacgagcatcctaagcaggttggtgctgttcctgacattgatgattttcgatatgtaaagaccgaggcaaaaacagcagtatctacaaagagggtaccagcatcatcaaataagaacagttcaccagtcaggttggagaaaaagatcagagtttcatctgttgtgaaagtggaagctccagaaaattgggaagcagttcttgaaggtattaaaaacattaggttatctggccaggcccccgtagatacaaagggctgtgaaaaggctggttctcttcttccacccaaggaaagaaggtttgcagttcttatatcaacaatgatgtcaagccagacaaaagatgaagttactcatgctgctgtggagtgtctcggtgagaacggtttacttgaccctgatgctatcgtcagaacagatgaggccacactggcaaatcttatcaaacctgttggattctatcagaggaaggcccaattcataaaagaagcttccagaatttgccttgagcgatttggaggagatattccagatactttgactgatctgcttgctttgaaaggagttggtcctaaaatggctcatctggtgatgagcattgcatggaagaatactcaaggaatctgtgtggacactcatgtgcatcgcatttctaaccgtcttggatgggtcttccgagaaggaacaaagcagaaaactactacaccagaacagacaaggatgtctcttgagaagtggctgcccaaggatgagtgggagccgataaacccactactggttggatttggtcagacaatctgtacgccgctgaggcccaaatgcggcagctgtggcataaacaccatttgcccatcagcttttaaggaagcgtcaagtcccaatccgaagcaaaagaagcgaggtctaggtccaacctagtcggcggggtgccctctgaaccttcttaacatgcgttagctactgatgtggtggtatggaaggtatatagtacaggtactttcctgggttcttttggctggcctatattgtttggatagcctcctttggcagtgccattggagaactatagtagtatcatccttttgtatagaagtaatatattatcgaccctgtcaagttgcaatatgattttccatgatcgaaggaaaatcgtccaagtttaatcccaaaaaaaaaaaaaaaa

SEQ ID NO: 5194 - protein, 1766 aa, Triticum aestivum
  misc_feature: PFam Name: HhH-GPD; PFam Description: HhH-GPD superfamily
  misc_feature: GI Number: 62734224; NR Description: endonuclease III homologue [Oryza sativa (japonica cultivar-group)] >gi|62734175|gb|AAX96284.1| endonuclease III homologue [Oryza
  misc_feature: GI Number: 21537257; NR Description: putative endonuclease
  misc_feature: GI Number: 11181952; NR Description: endonuclease III
  misc_feature: GI Number: 20259623; NR Description: putative endonuclease [Arabidopsis thaliana] >gi|17380754|gb|AAL36207.1| putative
  misc_feature: GI Number: 20198157; NR Description: putative endonuclease [Arabidopsis thaliana] >gi|18402669|ref|NP_565725.1|
CCCACCCACCAAGACGAAGACAGGGGAAAAGTTGGAAAGCAACCAGCAGCCCTGTTCCTCCCTCCCTCCCTCCCTCCCGTTGCTCATAAAACCCTAACGCAGTGGCGCGCACCAGCCGCCCATGCCCTTTCAGTTGCATCTCCTCCCGTCCCGCATTGGCCTCTTCTCGTCGATCTCCGCCATGTCCAGCTCGCGGCGCGCCTCCAGGCTCACCCGCGCATCCCGCCCGGAGCTCAGCCCAGCTGAAAGTGCAAGGGAAGTGAAGCGTGAACCCGGTGTTTCTTTTGACTACTCCAAGTCTGAAATGAATTCCGTCAAGAGGAAAAGGCTGAACCGTGTGCTTGAAGTAAAGGAGGAGCTTCCTAAGAAGCAGGTTGGTATTGTTCCTGACATCGAAGAATTTCGATATGTGAAGACCGGGGCAAAAATGTCAGTAACTGCAAAGAGGGTACCAGCATCATCAAATAAGAACAGTTCACCAGGTGTAAAGGAAGTGAAGTGTGAACCCAGTGTTTCTTTTGACTACTCCAAGTCTGAAATGAATTCCGTGGAGAGGAAAAGGCTGAACCGTGTGCTTGAAGTAAATGACGAGCATCCTAAGCAGGTTGGTGCTGTTCCTGACATTGATGATTTTCGATATGTAAAGACCGAGGCAAAAACAGCAGTATCTACAAAGAGGGTACCAGCATCATCAAATAAGAACAGTTCACCAGTCAGGTTGGAGAAAAAGATCAGAGTTTCATCTGTTGTGAAAGTGGAAGCTCCAGAAAATTGGGAAGCAGTTCTTGAAGGTATTAAAAACATTAGGTTATCTGGCCAGGCCCCCGTAGATACAAAGGGCTGTGAAAAGGCTGGTTCTCTTCTTCCACCCAAGGAAAGAAGGTTTGCAGTTCTTATATCAACAATGATGTCAAGCCAGACAAAAGATGAAGTTACTCATGCTGCTGTGGAGTGTCTCGGTGAGAACGGTTTACTTGACCCTGATGCTATCGTCAGAACAGATGAGGCCACACTGGCAAATCTTATCAAACCTGTTGGATTCTATCAGAGGAAGGCCCAATTCATAAAAGAAGCTTCCAGAATTTGCCTTGAGCGATTTGGAGGAGATATTCCAGATACTTTGACTGATCTGCTTGCTTTGAAAGGAGTTGGTCCTAAAATGGCTCATCTGGTGATGAGCATTGCATGGAAGAATACTCAAGGAATCTGTGTGGACACTCATGTGCATCGCATTTCTAACCGTCTTGGATGGGTCTTCCGAGAAGGAACAAAGCAGAAAACTACTACACCAGAACAGACAAGGATGTCTCTTGAGAAGTGGCTGCCCAAGGATGAGTGGGAGCCGATAAACCCACTACTGGTTGGATTTGGTCAGACAATCTGTACGCCGCTGAGGCCCAAATGCGGCAGCTGTGGCATAAACACCATTTGCCCATCAGCTTTTAAGGAAGCGTCAAGTCCCAATCCGAAGCAAAAGAAGCGAGGTCTAGGTCCAACCTAGTCGGCGGGGTGCCCTCTGAACCTTCTTAACATGCGTTAGCTACTGATGTGGTGGTATGGAAGGTATATAGTACAGGTACTTTCCTGGGTTCTTTTGGCTGGCCTATATTGTTTGGATAGCCTCCTTTGGCAGTGCCATTGGAGAACTATAGTAGTATCATCCTTTTGTATAGAAGTAATATATTATCGACCCTGTCAAGTTGCAATATGATTTTCCATGATCGAAGGAAAATCGTCCAAGTTTAATCCCAAAAAAAAAAAAAAAA

SEQ ID NO: 5195 - DNA, 1627 bp, Triticum aestivum
  misc_feature (1)..(1627): Ceres cDNA ID no. 22005630
  misc_feature (1)..(1627): Ceres CLONE  ID no. 827765
  misc_feature (1)..(1627): Also known as  Ceres CDNA ID no. 24409935
cccgagccctggagaaattgctagccgctgacaagtggggaacagcttgcaacagtcagcccccgagaccccgactcctccacctccttcgcccatcgcctcgccgccgcctccctcgctcctctcccctcccttctcgggctcgggcgcctcctccagtacagtcagtccccgtctccccttaaaccctcggcgcgaacccgaggaccccttccacattccttgcccctctcgcaagccccgccatgtcccgcatcgcgaggtcgcgcctcgccctcacgctcaggtcctccgccgcccccttctccaccatttcacccgccgccgccggcgcatccctcgcttcgaaggaggcgcctgccgccgccgacgcatcttccgctcccaaggaggccgccgccgctggcgatccctccccggcaccgccttcgggggcccgcagttccttcggtctgctcaaggccggtatcttcaccgctgtcaccgccgctctcggcgccacaggctatgtcacatacgcttattccgtggatgaagtggatcagatgacgcgggagttccggaagaactcgaagctcccaatcagcgaggacttgtccggctttgagaagtttaaggctacggcttattcagaaactatgaaagttcctgctgctgctattgacctctacttggatgtcaggagccaaattgaagatcaaattcagggatttgttgaaccatcatcagaaaaactccttccagatctacctcctcaagaacagcatgtctttaccatagttctggatctgaatgagactcttgtatactcagattggaagcgtgagagaggatggaggacttttaagagaccaggagtggatgcctttttggagcatcttgcgaagttctatgaagttgttgtgtattctgatcaattaagtatgtacgttgatcctgttatggaaagactggatacaaaaggctgtgtccggcacaggctatcaagagttgcaactaaatatgtgaatggaaagcactaccgggatctgtcaaagctgaatagagaccctgcacgagttatttatatcagtgggcatgctcttgagtcatgcctgcagcctgaaaattgtttgccgatcaaaccatggaagcttgaagctgaggacactcaactgattgatcttattccattgcttgaatatgtcgctacggcaagagtttctgacatcagacctgtccttgcatcctttgaaggccgtgacatcgctgctgaatttcttgagcgttcaaggcgcgtgtttgaacaaaaacagcaacatgcgtctggacgcatttggcggcgatgatgaatgaatctgctggtagggaagcagatcattccaccaacttcaatacacctagaactttttttagaactgtaagacttgtctttgtaattttgtcaactttgatttcagaaatcgcctacttttggtaattgcatcatgtttcaattactataggtgtcttggactgatgtctgaccaagctatatgagaatttcatgatcatgcgaggcgcatgtcaatttaaagttcactttgttgacatttgacaatatgataatttgttaaaaggagcttccagtacaaaaaaaaaaaaaaaa

SEQ ID NO: 5196 - protein, 360 aa, Triticum aestivum
  misc_feature: PFam Name: NIF; PFam Description: NLI interacting
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: Drf_FH1; PFam Description: Formin Homology Region 1
  misc_feature: GI Number: 8778307; NR Description: F14J16.15 [Arabidopsis
  misc_feature: GI Number: 34909768; NR Description: P0512C01.26 [Oryza sativa (japonica cultivar-group)] >gi|20804683|dbj|BAB92371.1|
  misc_feature: GI Number: 66847108; NR Description: mitochondrial translocase complex component (Tim50), putative [Aspergillus
  misc_feature: GI Number: 28261333; NR Description: TIM50 [Neurospora crassa]
  misc_feature: GI Number: 46435369; NR Description: potential mitochondrial presequence translocase guide protein [Candida albicans SC5314] >gi|46435327|gb|EAK94711.1| potential mitochondrial presequence
MSRIARSRLALTLRSSAAPFSTISPAAAGASLASKEAPAAADASSAPKEAAAAGDPSPAPPSGARSSFGLLKAGIFTAVTAALGATGYVTYAYSVDEVDQMTREFRKNSKLPISEDLSGFEKFKATAYSETMKVPAAAIDLYLDVRSQIEDQIQGFVEPSSEKLLPDLPPQEQHVFTIVLDLNETLVYSDWKRERGWRTFKRPGVDAFLEHLAKFYEVVVYSDQLSMYVDPVMERLDTKGCVRHRLSRVATKYVNGKHYRDLSKLNRDPARVIYISGHALESCLQPENCLPIKPWKLEAEDTQLIDLIPLLEYVATARVSDIRPVLASFEGRDIAAEFLERSRRVFEQKQQHASGRIWRR

SEQ ID NO: 5197 - DNA, 1730 bp, Triticum aestivum
  misc_feature (1)..(1730): Ceres cDNA ID no. 22005631
  misc_feature (1)..(1730): Ceres CLONE  ID no. 828351
  misc_feature (1)..(1730): Also known as  Ceres CDNA ID no. 24407924
actcgattcagttcaagtttccagcaccggccaccgggaagcagcggggcgcgcagtgggaaagaaggaacgccgcaagagaagagaagggcgctgcgaccgcgctgctcgccgcggcagagatccggcggcggcgctcgaatcgacggccatgatgaggcacagagctcgctcttcccccagctcccctctcaccccatcctccagcacgagagtgaagaagatatttggtttctccgtatctctcatcctcatcaatctggcttctattatggagcgtgctgatgagaatcttcttccagcagtttacaaggaagtcggtgcagccttcaatgctggtcccactgacctgggataccttaattttgtaatgaactttcttaagtcgatagcatcgcccttggccggcatccttgctcttcactatgatcgcccagcagtgcttgcaataggaactgtcttctgggccttatcaacaggggctgttggtgttagccagcattttcagcaggttgcattctggagagctataaatggccttggacttgccattgtaataccagcacttcagtcgttcatagcggatagctacaaagatggtacacgcggagctgggtttggtttgttaagcctcatcggtgcagtaggaggtataggtggtagtattgtggcaacactcatggctgggaaggactactggggattgcccgggtggcgtcttgcttttattatggttgcgcttgtcagcttcataattggaattcttgtctacttgtattctactgatccaagaagaatccctggaaatcatcttcttgatgacgacgactacgagaggtcacatctgtccagcaaagatgttcttcctccgacctctatctggatggattcttgggtagcaatgaagagtgtcatgaaagtgaagacatttcagatcattgtgttgcaggggataattggctcattgccctggaccgccatagttttcttcaccatgtggtttgaactcattggttttgacaataggagttctgcagcattgaacagcctattcgccattgggtgcgccagtggagctctccttggtggtgtactagcagaccgcctgtcacggcactatcccgattctgcacgcatcatgtgcgctcagtttagcgccttcatgggcattcctttctcatggatccttcttacagtcattcctcagtcaactgactactggtttgcctacgccgtcacactcttcttcatgggtatcaccatcagctggtgtgctacttccgcaaacaaccccatgttcgcggaggtagtccctcccaagcaccgcaccatgatctacgcctttgaccgggcttttgagggttcattcgcctcactggccgctcctgctgttggcttggtcactgagaagatatatggctacgacgccaagactgtaaacatcgcaaacggatcagcacaaggggcgtatgcgctgtcgagagggctactaaccatgatgatccttccttttggtatttgtgtcctgttctacagccctttgtaccttgtgttcaagcacgacagagacaatgccaaggtagccagattcaaggaccaggagctaatctgaaaataaaaatatttctgcagtgatgtttctgataaggattcgagcttatttgtgaatgttttggttgtaaatcggagcaaaagacaatatatgctatcagcgaaaaaaaaaaaaaaaa

SEQ ID NO: 5198 - protein, 1730 aa, Triticum aestivum
  misc_feature: PFam Name: MFS_1; PFam Description: Major Facilitator Superfamily
  misc_feature: PFam Name: Sugar_tr; PFam Description: Sugar (and other)
  misc_feature: GI Number: 50935147; NR Description: membrane transporter PFB0275w-like protein [Oryza sativa (japonica cultivar-group)] >gi|34393426|dbj|BAC82966.1| membrane transporter PFB0275w-like
  misc_feature: GI Number: 42569131; NR Description: transporter-related
  misc_feature: GI Number: 50899822; NR Description: transporter-like protein [Oryza sativa (japonica cultivar-group)] >gi|49389119|dbj|BAD26398.1| transporter-like protein [Oryza sativa
  misc_feature: GI Number: 50945665; NR Description: transporter-like protein [Oryza sativa (japonica cultivar-group)] >gi|37806444|dbj|BAC99637.1| transporter-like protein [Oryza sativa
  misc_feature: GI Number: 50899826; NR Description: transporter-like protein [Oryza sativa (japonica cultivar-group)] >gi|49389121|dbj|BAD26400.1| transporter-like protein [Oryza sativa
ACTCGATTCAGTTCAAGTTTCCAGCACCGGCCACCGGGAAGCAGCGGGGCGCGCAGTGGGAAAGAAGGAACGCCGCAAGAGAAGAGAAGGGCGCTGCGACCGCGCTGCTCGCCGCGGCAGAGATCCGGCGGCGGCGCTCGAATCGACGGCCATGATGAGGCACAGAGCTCGCTCTTCCCCCAGCTCCCCTCTCACCCCATCCTCCAGCACGAGAGTGAAGAAGATATTTGGTTTCTCCGTATCTCTCATCCTCATCAATCTGGCTTCTATTATGGAGCGTGCTGATGAGAATCTTCTTCCAGCAGTTTACAAGGAAGTCGGTGCAGCCTTCAATGCTGGTCCCACTGACCTGGGATACCTTAATTTTGTAATGAACTTTCTTAAGTCGATAGCATCGCCCTTGGCCGGCATCCTTGCTCTTCACTATGATCGCCCAGCAGTGCTTGCAATAGGAACTGTCTTCTGGGCCTTATCAACAGGGGCTGTTGGTGTTAGCCAGCATTTTCAGCAGGTTGCATTCTGGAGAGCTATAAATGGCCTTGGACTTGCCATTGTAATACCAGCACTTCAGTCGTTCATAGCGGATAGCTACAAAGATGGTACACGCGGAGCTGGGTTTGGTTTGTTAAGCCTCATCGGTGCAGTAGGAGGTATAGGTGGTAGTATTGTGGCAACACTCATGGCTGGGAAGGACTACTGGGGATTGCCCGGGTGGCGTCTTGCTTTTATTATGGTTGCGCTTGTCAGCTTCATAATTGGAATTCTTGTCTACTTGTATTCTACTGATCCAAGAAGAATCCCTGGAAATCATCTTCTTGATGACGACGACTACGAGAGGTCACATCTGTCCAGCAAAGATGTTCTTCCTCCGACCTCTATCTGGATGGATTCTTGGGTAGCAATGAAGAGTGTCATGAAAGTGAAGACATTTCAGATCATTGTGTTGCAGGGGATAATTGGCTCATTGCCCTGGACCGCCATAGTTTTCTTCACCATGTGGTTTGAACTCATTGGTTTTGACAATAGGAGTTCTGCAGCATTGAACAGCCTATTCGCCATTGGGTGCGCCAGTGGAGCTCTCCTTGGTGGTGTACTAGCAGACCGCCTGTCACGGCACTATCCCGATTCTGCACGCATCATGTGCGCTCAGTTTAGCGCCTTCATGGGCATTCCTTTCTCATGGATCCTTCTTACAGTCATTCCTCAGTCAACTGACTACTGGTTTGCCTACGCCGTCACACTCTTCTTCATGGGTATCACCATCAGCTGGTGTGCTACTTCCGCAAACAACCCCATGTTCGCGGAGGTAGTCCCTCCCAAGCACCGCACCATGATCTACGCCTTTGACCGGGCTTTTGAGGGTTCATTCGCCTCACTGGCCGCTCCTGCTGTTGGCTTGGTCACTGAGAAGATATATGGCTACGACGCCAAGACTGTAAACATCGCAAACGGATCAGCACAAGGGGCGTATGCGCTGTCGAGAGGGCTACTAACCATGATGATCCTTCCTTTTGGTATTTGTGTCCTGTTCTACAGCCCTTTGTACCTTGTGTTCAAGCACGACAGAGACAATGCCAAGGTAGCCAGATTCAAGGACCAGGAGCTAATCTGAAAATAAAAATATTTCTGCAGTGATGTTTCTGATAAGGATTCGAGCTTATTTGTGAATGTTTTGGTTGTAAATCGGAGCAAAAGACAATATATGCTATCAGCGAAAAAAAAAAAAAAAA

SEQ ID NO: 5199 - DNA, 1422 bp, Triticum aestivum
  misc_feature (1)..(1422): Ceres cDNA ID no. 22005632
  misc_feature (1)..(1422): Ceres CLONE  ID no. 828445
  misc_feature (1)..(1422): Also known as  Ceres CDNA ID no. 24407930
agtttaaaactacgagaggcaatcttctggtcatcccaagttactagtagtattttccaacagagaggcagagttgcagaactgtaattttgtaaggaaccacatggaagccacctcagaacaagacggaggtggcagcggcgccggcgactacgaagctctcgtggcagccctgatggccaacaggcaactgctggaagccaaggtcggcatcaacaacgcaatgttcgccgccagcgatctggctacgtcgcagctcggcgattccttcgtcgtcggcgggtgcgaagggcagaagaccatcgacggcgagcagatgccactggtcctgggcccggcaagggaaggcgctggcgaagacggcggcactgggtacgaggcgctcgtggccgctgtgagggccaagagagaatggctggaggacaaggtggtgaccaacagcgccgttctgctgcggggcttcgatgtccgcgacgcggcggagttcgacgccgtcgtggaggcgcttgggtggccggacatccggtacgtcggccccgcgccgcgcacccacgttcacggccgaatctggacctccaacgaggggcccctcgagcagagcgtctacttccaccatgagatggtgctgatcaaggagttcccggcgaaggtgatactgttctgtgaggtgccgccgccggagggcggagagacgccgttcgtgccgagcttccgggtgacggagcgggcgctggaggagttcccggagatggtggaggagatggtggaggagctggacgccaaggggctccggtacacgttcacggcgccgagcaacaacaacaccgggtccatgagagggaggggatgggaggacgctttcggcacgtcagacaagtctgaagcagagacgagggcaaaggcactaggaatgggcgtggagtggcttgaggacggtggcgtgaagacgatcctgggtccacgcacgctgacccgcgtcttcccagggcgcaagggacggaggatgtggttcaacacgttggtcgggatgcacggcaaggaactgagctcggccacggtggccgacggggccgagatcccggcgagcttcgtgcaacggtgcgaggagatcatcgaggaggagagcatccagttccgttggcgcaagggcgacatcctcatcctcgacaacctcgccacgctacacggccggcggccgtcgctgccgcctaggcgggttctcgtcgcaacttgcaagtgacgcaccgatgagttctttttatttattgatcagaacactcccacatctgccatgtggcgcatccaatagcttatcagcgtatggcattcgaatcagtacaacacgatttaactgggtcgcgtctagtatctcgccccatgtaaaagcgcagttgaacctttcccacaaaaaaaaaaaaaaaa

SEQ ID NO: 5200 - protein, 378 aa, Triticum aestivum
  misc_feature: GI Number: 50945219; NR Description: putative Signal peptidase I [Oryza sativa (japonica cultivar-group)] >gi|40253889|dbj|BAD05823.1| putative Signal peptidase I [Oryza
  misc_feature: GI Number: 55771308; NR Description: syringomycin
  misc_feature: GI Number: 34906388; NR Description: P0710E05.6 [Oryza sativa (japonica cultivar-group)] >gi|9049456|dbj|BAA99421.1| P0710E05.6
  misc_feature: GI Number: 61101586; NR Description: syrP protein [Erythrobacter litoralis HTCC2594] gi|60735693|gb|EAL73954.1| syrP
  misc_feature: GI Number: 23128425; NR Description: COG2175: Probable
MEATSEQDGGGSGAGDYEALVAALMANRQLLEAKVGINNAMFAASDLATSQLGDSFVVGGCEGQKTIDGEQMPLVLGPAREGAGEDGGTGYEALVAAVRAKREWLEDKVVTNSAVLLRGFDVRDAAEFDAVVEALGWPDIRYVGPAPRTHVHGRIWTSNEGPLEQSVYFHHEMVLIKEFPAKVILFCEVPPPEGGETPFVPSFRVTERALEEFPEMVEEMVEELDAKGLRYTFTAPSNNNTGSMRGRGWEDAFGTSDKSEAETRAKALGMGVEWLEDGGVKTILGPRTLTRVFPGRKGRRMWFNTLVGMHGKELSSATVADGAEIPASFVQRCEEIIEEESIQFRWRKGDILILDNLATLHGRRPSLPPRRVLVATCK

SEQ ID NO: 5201 - DNA, 1810 bp, Triticum aestivum
  misc_feature (1)..(1810): Ceres cDNA ID no. 22005633
  misc_feature (1)..(1810): Ceres CLONE  ID no. 830634
  misc_feature (1)..(1810): Also known as  Ceres CDNA ID no. 24430742
aagatcttaggtcctcacgctcacgccggcagatttgttacatctggacggcgtcgccacttgcactcccacgctgcaacatagctgcctccactcctccacacactagcgccgctgtccagctgatttgcttcgagatggacatgtgcatgggcatggccaagctgctgctgctgctgctgctcctcgtggtcaccgccagccacggccacgcggcggcggcggcggcggggaaggagaggaacacgatcacgcacgtcaaggggttcgacggcccgctgcccttcgccctggagaccgggtacgtggaggtggacgaggcgcacggcgccgagctcttctactacttcatccagtcggagcgcagcccgcgggaggacccgctcatcctctggatcaccggcggccccggctgctccgcgctctcgggcctcctcttcgagatcgggcccctcaagttcgacgtggcggggtacaccgagggcttcccgcgcctcgtctacttcgaggactcgtggacccgggtcagcaacgtcatcttcctcgacgcgcccgtgggcaccggcttctcctatgcgcgcgacgaggagggcctcgacgtcagcctcaccggcaccggcacgcacctccgggtgttcctgcagcggtggatcgctgatcaccctgagttcgcctccaacccactctacatcggcggcgactcctactccgggtacaccgtcccggtcgccgcgctcgagatcgccgaccagccggataagggagggctgaacctcaaggggtacctggtgggcaacgccggcaccgacgacaagtacgactccggcggcaaggtccccttcatgcacggcatggggctcatctccgacgagctctacgaggcggcgaagggcagctgcggcggggacttcgtgacgacgcccaggaacgtgcagtgcgccaacgcgctcatggcgatcaccatggccaccttcgccgtcaacccggtgcacatcctcgagcccatgtgcggcctggcgctgcgccctccgacgaccccaatcagcagcatcctctccacgggcacgaggagaaggtcggcgaggctgctggtgcaggaggcggaccggctggcgctcccggtggagtgccgggacaacgggtaccggctgtcctacacctgggcggacgacgcggaggtgagggcgacgctgggcatccgggaggggtcggtcggcgcgtggagccggtgcgtcacgctgacgcacttccggcacgacgtgtacagcaccgtgccctaccacgccaacctgacgcggcgcggctaccgcgcgctggtgtacaacggcgaccacgacctggacatgaccttcgtgggcacgcaggcgtggatccggacgctggggtaccccgcggtggcgccgtggcggccgtggtacgccaaccggcaggtcgccgggttcacgacggagtacgcccacaacctcaccttcgccaccgtcaagggcggcggccacaccgcgcccgagtaccgccccaaggagtgcctcgccatgctcgacaggtggacctccgccgacggcaggctctgagcctgtgatccgactcgccactccgttgccatcggtcggagtactatatacatactgcctacgagtacaaatgagtgtactgtatgtatatttcgatttggaacagggctagctgttcacatcattgcatgtacggtgtcgtactattgattgaagtgccatgcacacgagaggacgaagacataaataaaagtcagaaaaaacctggagagttcaaaaaaacaaaaaaaaaaaaaaaa

SEQ ID NO: 5202 - protein, 477 aa, Triticum aestivum
  misc_feature: PFam Name: GRP; PFam Description: Glycine rich protein family
  misc_feature: PFam Name: Upf2; PFam Description: Up-frameshift suppressor 2
  misc_feature: PFam Name: Sporozoite_P67; PFam Description: Sporozoite P67
  misc_feature: PFam Name: Mucin; PFam Description: Mucin-like glycoprotein
  misc_feature: PFam Name: Daxx; PFam Description: Daxx Family
  misc_feature: GI Number: 295899; NR Description: nucleolin [Xenopus laevis]
  misc_feature: GI Number: 32418034; NR Description: predicted protein [Neurospora crassa] >gi|28924967|gb|EAA34056.1| predicted protein
  misc_feature: GI Number: 6178156; NR Description: nucleolin like protein
  misc_feature: GI Number: 12018306; NR Description: nucleolin-related protein [Rattus norvegicus] >gi|5929884|gb|AAD56625.1|
  misc_feature: GI Number: 61831052; NR Description: PREDICTED: similar to
MDMCMGMAKLLLLLLLLVVTASHGHAAAAAAGKERNTITHVKGFDGPLPFALETGYVEVDEAHGAELFYYFIQSERSPREDPLILWITGGPGCSALSGLLFEIGPLKFDVAGYTEGFPRLVYFEDSWTRVSNVIFLDAPVGTGFSYARDEEGLDVSLTGTGTHLRVFLQRWIADHPEFASNPLYIGGDSYSGYTVPVAALEIADQPDKGGLNLKGYLVGNAGTDDKYDSGGKVPFMHGMGLISDELYEAAKGSCGGDFVTTPRNVQCANALMAITMATFAVNPVHILEPMCGLALRPPTTPISSILSTGTRRRSARLLVQEADRLALPVECRDNGYRLSYTWADDAEVRATLGIREGSVGAWSRCVTLTHFRHDVYSTVPYHANLTRRGYRALVYNGDHDLDMTFVGTQAWIRTLGYPAVAPWRPWYANRQVAGFTTEYAHNLTFATVKGGGHTAPEYRPKECLAMLDRWTSADGRL

SEQ ID NO: 5203 - DNA, 1393 bp, Triticum aestivum
  misc_feature (1)..(1393): Ceres cDNA ID no. 22005635
  misc_feature (1)..(1393): Ceres CLONE  ID no. 831107
  misc_feature (1)..(1393): Also known as  Ceres CDNA ID no. 24409593
aaacatgattggacggattcttcgttgcatactttaatacgatgggagagaaaatcgacagttcctactgtggatgggttgatttcggctatgggttcggttgacaaagggaaccatcacttgtcgtcgtgtttcagaaactctagagaagctgaagacagtacaagtaatgggtttgagaaaagagatctcccatcagatatttgcttatctccagcacatagagtattaattgcactaagggaatctgtaatgctgcgaaccaatgtgaacatactgtatcagggtgatctgaataaactcgaggaagcggagttggccccgatagcaatccttttctctggtggcctggactccatgatacttgcagcattattagaccagtgccttgattccaaatggacaattgatttgctgaatgtcagttttgatgggcagctagctccagatagagtttcttcactggcaggactgaaggagcttcagagaatctcccctctgcggagatggcgtcttgttgagattgacagtaatttggccaacttgaaagaggaaagtgaacacgtgatgtcactgatatacccttcaaatacatatatggatttgaacattggtgtagccctatggttagctgctagcggggatggttgggtgaatgggcaagatggtgatcgctacaaacacaagtcaacatctagagtccttttagtcggttctggagctgatgagcagtgtgctggttatggtagacatcgtactaaatatagagttggaggatgggtttcactggacgaggaaatgagactagatgtgcaaagaatttggaaaagaaacatgggaagagatgataggtgcatttctgaccatggcaaggaggctcgttttccatttcttgatgagagtgtgatcagaacattgttggaaatcccactatgggatatcgctaaacttgatgagcccgtggggaagggtgataagaagattctgagagaggttgcaaagctgctgggtctacaagaagctgcttttttgccaaagcgagcaatccagtttggttcaagaatagcaagggaatcaaaccgcaagaactttggcagcaaccgagccgcgaacctggcatcggcaggcagcgtggaggtccacaagcgtaaccactgacggggcaaacagacctaaatcgacatgccagatgctgcattgccacatgttcccagcggcacagatgccggtgatcggtccggttcttctgttcagttcatcctgttatgggttgtagtcatgttggcatgaagcatgccaatgctttatcactggctgttcagccatgaaaattttgttctttctcataccgtcttattcattgcaaccatggataacaaaaaaaaaaaaaaaa

SEQ ID NO: 5204 - protein, 355 aa, Triticum aestivum
  misc_feature: PFam Name: Asn_synthase; PFam Description: Asparagine synthase
  misc_feature: GI Number: 50750035; NR Description: PREDICTED: similar to
  misc_feature: GI Number: 34875820; NR Description: similar to HCV
  misc_feature: GI Number: 15488990; NR Description: RIKEN cDNA 2210409M21
  misc_feature: GI Number: 62630095; NR Description: unknown [Homo sapiens]
  misc_feature: GI Number: 57110869; NR Description: PREDICTED: similar to
MGSVDKGNHHLSSCFRNSREAEDSTSNGFEKRDLPSDICLSPAHRVLIALRESVMLRTNVNILYQGDLNKLEEAELAPIAILFSGGLDSMILAALLDQCLDSKWTIDLLNVSFDGQLAPDRVSSLAGLKELQRISPLRRWRLVEIDSNLANLKEESEHVMSLIYPSNTYMDLNIGVALWLAASGDGWVNGQDGDRYKHKSTSRVLLVGSGADEQCAGYGRHRTKYRVGGWVSLDEEMRLDVQRIWKRNMGRDDRCISDHGKEARFPFLDESVIRTLLEIPLWDIAKLDEPVGKGDKKILREVAKLLGLQEAAFLPKRAIQFGSRIARESNRKNFGSNRAANLASAGSVEVHKRNH

SEQ ID NO: 5205 - DNA, 1590 bp, Triticum aestivum
  misc_feature (1)..(1590): Ceres cDNA ID no. 22005636
  misc_feature (1)..(1590): Ceres CLONE  ID no. 833868
  misc_feature (1)..(1590): Also known as  Ceres CDNA ID no. 24407645
agccttccctttccttcccacgcgaacaaaagaacaaaagaatccaaaaatccccaaatccccctccccttccacgccagctccgccctcaatccccaattccccacgcggccggcctccccaccagctcggatccccgccgccagcagctccgccatggagtgcgagcccgaggagctgcagttcctgggccccgtcggcatctaccgggagtcggtggccatcctgcgcgcgcaccgcccgctctacgcccgcatcgccgccgccttcgtcctcccgctctccgcgctcttcctcgcccacatcgccatctcccacgccctcttctccaccatcgactccgacgactccgccctcgagtcctccgcccccgggactgcctcccagcagcggatcctccagcggctcggcgccgactgggccgccctcgtcctcttcaaggccgcctacctcctcgcgctcctcctcttctcgctcctctccaccgccgccgccgtcttctccgtcgcctccgtctactccgccaagcacgacgcgctcaccttcccgcgggtgctctccgtcgtgccccgcgtctggcgccgcctcgcggtcaccttcctctccgcattcgcgctgctcttcgcctaccacttcgtcttcgccgtcgtcttcatcgcgctcctcgtcgccgtcgacaatggctccaccctcgccgggctcctcgccttcgtcgtcatcgtcgcctacctagtcgggctcgtctacctcagcgtcgtctggcacctcgccagcgtcgtctcggtgctcgaggactacaaggggttccaggccatgcgcaagagcaaggcgctcatccaggggaagctctggaccgtcgtgatcatcttcgtcacgctcaacatcgttttcatcgtcgtggagttcgccttccgcgcctggatcgtccagggcgcgcgccacggtctcggcgcgggagggaggctgctccttggcctcgtcatgctggctgcgctgtgctcggtcgtcatggtggcgctggtggtgcagacggtggtgtacctggtgtgcaagagctaccaccacgagagcatcgacaagagcaacatctccgaccacctcgaggtctacctcggcgactacgtcccgctcaaggccagcgacgtgcagatgcagcacttcggcgacgaggtctgacccctcccaaagatcgacctgcttctgtttgctctcttctctgtaataccactactagtctagtcacacaggaatcacaattccattgctggtcatttacccaaaacagaatgaaatggaaggaagctgaagagaagtaggatcatttgatcagcagtttctcagtaattatactcagctttgctatgacacgaggaacagttggatgttgcttgtactccctccgtcccaaaattcttgtcttagatttgtctaaatgcggatgcatcaagtcacgttttagtattaggttcatccgtatctagacaaatgtaagacaagaattttgggacagagggagtagtaatttgtaatggagggatgggattggtactgcactactgttactacatgctagcaaaaaaaaaaaaaaaa

SEQ ID NO: 5206 - protein, 339 aa, Triticum aestivum
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: LMBR1; PFam Description: LMBR1-like membrane protein
  misc_feature: PFam Name: GATase_2; PFam Description: Glutamine
  misc_feature: GI Number: 34908936; NR Description: P0691E06.20 [Oryza sativa (japonica cultivar-group)] >gi|19570984|dbj|BAB86411.1| P0003D09.5 [Oryza sativa (japonica cultivar-group)] >gi|20804736|dbj|BAB92422.1| P0691E06.20 [Oryza sativa (japonica
  misc_feature: GI Number: 13592175; NR Description: ppg3 [Leishmania major]
  misc_feature: GI Number: 42734036; NR Description: similar to Leishmania
  misc_feature: GI Number: 5420387; NR Description: proteophosphoglycan
  misc_feature: GI Number: 11359723; NR Description: proteophosphoglycan, membrane-associated [imported] - Leishmania major (fragment)
MECEPEELQFLGPVGIYRESVAILRAHRPLYARIAAAFVLPLSALFLAHIAISHALFSTIDSDDSALESSAPGTASQQRILQRLGADWAALVLFKAAYLLALLLFSLLSTAAAVFSVASVYSAKHDALTFPRVLSVVPRVWRRLAVTFLSAFALLFAYHFVFAVVFIALLVAVDNGSTLAGLLAFVVIVAYLVGLVYLSVVWHLASVVSVLEDYKGFQAMRKSKALIQGKLWTVVIIFVTLNIVFIVVEFAFRAWIVQGARHGLGAGGRLLLGLVMLAALCSVVMVALVVQTVVYLVCKSYHHESIDKSNISDHLEVYLGDYVPLKASDVQMQHFGDEV

SEQ ID NO: 5207 - DNA, 1736 bp, Triticum aestivum
  misc_feature (1)..(1736): Ceres cDNA ID no. 22005638
  misc_feature (1)..(1736): Ceres CLONE  ID no. 835571
  misc_feature (1)..(1736): Also known as  Ceres CDNA ID no. 24407621
gagctcgctcaagcgcctcaagtacgaagcctagagggatagtactgtactttcctctcccttcttctccgtctgcggtctgctgcttctgggcgtcaatggggagctctgccattttaggagaagcggagatcccctgaattggtcaatcagcattagtttgtttggtcgtttgatcatggatccctttcacggcattgtgaaagaggaggaattcgacttcgccggagctgcagcggatggctactcgccgtcttcctggggctcatccccgtcttcctggggctcttcccaatcttcctgggccggcggcggcgccttggcagagctgccgcggccgatggacggcctcggcgaggcgggccccacgcccttcctgaacaagacgtacgaggtggtggacgaccacagcacggacaccatcgtgtcgtggggcgtcgccgggaacagcttcgtggtgtgggacgcccacgccttctccatggtgctcctcccccgctacttcaagcactgcaacttctccagcttcgtccgccagctcaacacctatgggttcaggaaggttgatccggacaggtgggagttcgcggcggaggggttcctgcggggccagaaggagctgctgaagacgatcaggcgccggcggcctcagtcgtcgccgtctggcacgccggcgctgctgcagcagcagcagcagggccagcagggggcgtgcctggaggtggggcatttcgggcccgagggcgaggtgcagcggctgcagcgcgacaagggcaccctgatcgcggaggtggtgaagctgcggcaggagcagcaggcgacgcgagcgcagatgcaggagatggaggcgcgcctcgccgccacggagcagaagcagcagcagatgacggtgttcctggcgcgcgccatgaagagccccagcttcctccagatgctggtgcagcggcaggaccagagccggcggaaggagctcgcggaggcgctcctctccaagaagcgcggccgccccatcgagtacctcctcccccgcaacggcgagaccagcagcgccgcaagctacagcgccgcggcgcgaggctacggccctggtctcgccgacggcagtgacggcaggcgcgcggacggcgaggacacggagagcttctggaaggagctgctgagcctgggcctggaggagaggcatcgggaggctggcgggggcggcggggaggcgagcggcgccgaggtggacgacgacgtggacgatgaggtggacgagctggtgcagagcctctaccacctcagcccgaaccggccccacagccaccagtgaaggaagaacagaagacagaaggttctagagcgagaaatatctgctgccgcttggagaacaacgtagggccgcagcctgacaagtgacaaccccagcagtgagcgaaagaagataagaaggttctagaacaagaagtttccgctggagaacgtcgaacgtcgtggggtagaccgtaggcgtagtggtggtggtggtagcggtagtgctgcctccatgcccccatgggcgttgggggctggtctgctttgttcattttctattgctagttgtagtacctgacatgttgtcggggccccgcggcctgcatgcgcaagttgcccgaaacagaaaggggccagcgccttttgcctggcgtggtggaataatgctccgaggctttaccggattaagtactccaagttggacgtgaaaaaaaaaaaaaaaa

SEQ ID NO: 5208 - protein, 377 aa, Triticum aestivum
  misc_feature: PFam Name: HSF_DNA-bind; PFam Description: HSF-type DNA-binding
  misc_feature: PFam Name: MARCKS; PFam Description: MARCKS family
  misc_feature: PFam Name: 7tm_1; PFam Description: 7 transmembrane receptor
  misc_feature: PFam Name: PHO4; PFam Description: Phosphate transporter family
  misc_feature: GI Number: 50400035; NR Description: putative HSF-type
  misc_feature: GI Number: 19310749; NR Description: putative heat shock protein [Arabidopsis thaliana] >gi|15028343|gb|AAK76648.1| putative heat shock protein [Arabidopsis thaliana] >gi|9279701|dbj|BAB01258.1| heat shock transcription factor-like
  misc_feature: GI Number: 33087081; NR Description: heat stress protein
  misc_feature: GI Number: 19492; NR Description: heat shock transcription factor 8 [Lycopersicon peruvianum] >gi|100264|pir||S25481 heat shock transcription factor HSF8 - Peruvian tomato >gi|729775|sp|P41153|HSF8_LYCPE HEAT SHOCK FACTOR STRESS
  misc_feature: GI Number: 19260; NR Description: heat stress transcription factor 8 [Lycopersicon esculentum] >gi|100225|pir||S25478 heat shock transcription factor HSF8 - tomato >gi|11386827|sp|Q40152|HSF8_LYCES Heat shock factor protein
MDPFHGIVKEEEFDFAGAAADGYSPSSWGSSPSSWGSSQSSWAGGGALAELPRPMDGLGEAGPTPFLNKTYEVVDDHSTDTIVSWGVAGNSFVVWDAHAFSMVLLPRYFKHCNFSSFVRQLNTYGFRKVDPDRWEFAAEGFLRGQKELLKTIRRRRPQSSPSGTPALLQQQQQGQQGACLEVGHFGPEGEVQRLQRDKGTLIAEVVKLRQEQQATRAQMQEMEARLAATEQKQQQMTVFLARAMKSPSFLQMLVQRQDQSRRKELAEALLSKKRGRPIEYLLPRNGETSSAASYSAAARGYGPGLADGSDGRRADGEDTESFWKELLSLGLEERHREAGGGGGEASGAEVDDDVDDEVDELVQSLYHLSPNRPHSHQ

SEQ ID NO: 5209 - DNA, 1196 bp, Triticum aestivum
  misc_feature (1)..(1196): Ceres cDNA ID no. 22005639
  misc_feature (1)..(1196): Ceres CLONE  ID no. 838941
  misc_feature (1)..(1196): Also known as  Ceres CDNA ID no. 24409476
gccgtgacattcctccactctcgatcgccggctcgtccagttgccgcctccaaagagaagccatgaatgctgctctcaccgtcgccgtagccggggaagaaatcgacgaggccgtagccggggaagaaatcgacgaggccgcctctcgggctcaggctgacatgtcggagatcatgtcgtcgctcccacggtgcccggtgtaccttactcgccactaccgcggcttctggatccgcgagttcgtcctcaagggcatggccgccgctcaggcatccttcgagccaaggccaaccgacgtcttcctcgccagctgccccaagtccggcaccacctggctcaaggcgctcgcctttgcgacgctcaaccgcgccacgcacttgccgtccgactccaaccacccgctatgccaccgcaacccgcacgactgcgtcgccttcctccagaccaggcccgtgcctgagaccatggcgctcccttctccccggctgctcgcaacccacatcccctgctccctcctgcccagccgcataacggaatgcggccgggtcgtctacgtgtgccgggagccaaaggacgctctggtctccttctggatctacaacaacaagatcgcgccgatgctgcgccggaagttcggcctggagtctccctcgcccacgttcgaggaggcgttcgagctcttctgcgaggggcagagcagctccggaccgccatggcgccacgccctcgagtactgggaggagagccggaggaggcctgggaaggtgctcttcctcaggtacgaggacatgctgcaagaccccacaggcaacgccaacaatctcgctgcgttcatggggtgcccgttttcttgcgcagaggaggaggcaggggtggtgcaggagatcgtgcagctctgtagctttgagaaactcaagagctcggaggtgaacaagaatggcagcagcgccatgatgggcgtcaacaacgacgtatacttcaggaagggagcggtcggcgactggaaaaactacatgacgccggagatggcggcgcggctggacaagatcgtcgaggaggcgcttcaaggttcaggcctgacctttggcatctccatgtagaagggatggggagcgaattgttgctatgaagcataaattttcgtatttgacaatcccaaagaaaataaggtcttatgatcaaaaaaaaaaaaaaaa

SEQ ID NO: 5210 - protein, 345 aa, Triticum aestivum
  misc_feature: PFam Name: Sulfotransfer_1; PFam Description:
  misc_feature: GI Number: 62733814; NR Description: transposon protein,
  misc_feature: GI Number: 50251933; NR Description: putative steroid sulfotransferase [Oryza sativa (japonica cultivar-group)] >gi|50251910|dbj|BAD27848.1| putative steroid sulfotransferase
  misc_feature: GI Number: 50943387; NR Description: putative flavonol 3-sulfotransferase [Oryza sativa (japonica cultivar-group)] >gi|37805891|dbj|BAC99740.1| putative flavonol 3-sulfotransferase
  misc_feature: GI Number: 50942729; NR Description: putative flavonol 3-sulfotransferase [Oryza sativa (japonica cultivar-group)] >gi|40253317|dbj|BAD05251.1| putative flavonol 3-sulfotransferase
  misc_feature: GI Number: 34905060; NR Description: putative flavonol 4'-sulfotransferase [Oryza sativa (japonica cultivar-group)] >gi|28201268|dbj|BAC56777.1| putative flavonol 4'-sulfotransferase
MNAALTVAVAGEEIDEAVAGEEIDEAASRAQADMSEIMSSLPRCPVYLTRHYRGFWIREFVLKGMAAAQASFEPRPTDVFLASCPKSGTTWLKALAFATLNRATHLPSDSNHPLCHRNPHDCVAFLQTRPVPETMALPSPRLLATHIPCSLLPSRITECGRVVYVCREPKDALVSFWIYNNKIAPMLRRKFGLESPSPTFEEAFELFCEGQSSSGPPWRHALEYWEESRRRPGKVLFLRYEDMLQDPTGNANNLAAFMGCPFSCAEEEAGVVQEIVQLCSFEKLKSSEVNKNGSSAMMGVNNDVYFRKGAVGDWKNYMTPEMAARLDKIVEEALQGSGLTFGISM

SEQ ID NO: 5211 - DNA, 1140 bp, Triticum aestivum
  misc_feature (1)..(1140): Ceres cDNA ID no. 22005640
  misc_feature (1)..(1140): Ceres CLONE  ID no. 841457
  misc_feature (1)..(1140): Also known as  Ceres CDNA ID no. 24408642
aacatatttcggtcagctcacctagctagtcacgtattgacagcacaaaaggcatgccgttattcttcaggcggatcacgcgatgtcgacgagcctggtcatcggtaggtgcgaagtgccaatcttcgggcaccatcgacggcgacgcctccaaagtccaaaccccacgcactcggcattgccgccggcaccacgatatcaccgccccgccggtgtcatgaggcctctgctctcccgcctattcgcccccagttacatcgccatggccgccccctccgcatcgccgtcccgacggcttgcccacctcacacgccacctcctcgcctcttcctcgtcctcctcttccggcgagctctcctcggtgggcgcccccgcccccgccgcctccagcccggcccgcgcggccgcatccaaggccttcgccgccgtgctggtctgcatcttcgaggacacacgcggggacccccgcgtcctcctcaccaaacgcgcctccaccctctcgtcccattcaggggaggtgtcgttgccgggaggcaaggtggatcagggggatgtggatgttaaggccaccgctctgcgggaggcagaggaggagattgggctggacccggcgcttgtatctgttgtgacagttcttgagcccttcttgtccaagaatggccttgatgttactcctgtaattggcattctttcggatagagctctattcaatcctgtcttgaataaagctgaagtgcaagacatctttgacgcccctctggagatgtttctgaaggatgataaccggacaacaagacaaagggactggatggggaagactattccggtccagttctttgactacgaggcagagggcaaaaaatatgtcatttggggcttgaccgcacacattctgacccgtgctgcatcagtcgttctacagagggagtatgtaattgtagcaatttttacaccccatttactggtacaagaggctatcagaagtctaaaattaaacaggtaatgtatatctgtagagatgtaatttgcattgcatgtatagcacaggaagtagtatcctggaacattttgtgacatcctcttttgagttcagagtcaagacaatgaacgctctgtggaatgttaaaaaaaaaaaaaaaa

SEQ ID NO: 5212 - protein, 306 aa, Triticum aestivum
  misc_feature: PFam Name: NUDIX; PFam Description: NUDIX domain
  misc_feature: PFam Name: Extensin_2; PFam Description: Extensin-like region
  misc_feature: PFam Name: LMBR1; PFam Description: LMBR1-like membrane protein
  misc_feature: PFam Name: GATase_2; PFam Description: Glutamine
  misc_feature: PFam Name: Pyr_redox_2; PFam Description: Pyridine
  misc_feature: GI Number: 50945105; NR Description: putative phosphohydrolase [Oryza sativa (japonica cultivar-group)] >gi|40253324|dbj|BAD05258.1| putative phosphohydrolase [Oryza sativa (japonica cultivar-group)] >gi|40253358|dbj|BAD05290.1|
  misc_feature: GI Number: 42570219; NR Description: MutT/nudix family protein [Arabidopsis thaliana] >gi|18396900|ref|NP_564316.1|
  misc_feature: GI Number: 10764850; NR Description: F1K23.5 [Arabidopsis thaliana]
  misc_feature: GI Number: 21553389; NR Description: unknown [Arabidopsis thaliana]
  misc_feature: GI Number: 23470438; NR Description: COG0494: NTP pyrophosphohydrolases including oxidative damage repair enzymes
MSTSLVIGRCEVPIFGHHRRRRLQSPNPTHSALPPAPRYHRPAGVMRPLLSRLFAPSYIAMAAPSASPSRRLAHLTRHLLASSSSSSSGELSSVGAPAPAASSPARAAASKAFAAVLVCIFEDTRGDPRVLLTKRASTLSSHSGEVSLPGGKVDQGDVDVKATALREAEEEIGLDPALVSVVTVLEPFLSKNGLDVTPVIGILSDRALFNPVLNKAEVQDIFDAPLEMFLKDDNRTTRQRDWMGKTIPVQFFDYEAEGKKYVIWGLTAHILTRAASVVLQREYVIVAIFTPHLLVQEAIRSLKLNR

SEQ ID NO: 5213 - DNA, 1458 bp, Triticum aestivum
  misc_feature (1)..(1458): Ceres cDNA ID no. 22005642
  misc_feature (1)..(1458): Ceres CLONE  ID no. 860021
  misc_feature (1)..(1458): Also known as  Ceres CDNA ID no. 23414404
aaaaagccccggaaagattttgcctttgctttcttcccaataacctccgccctcgtctcgcctcgcctcgccccgtgtgttatctatccccgtcctgcacatccacccatcacgccgccctgcgctccctcgtctccccccaccccccaccgtctctctccctctctctctctctcctccgcgccgctttctagggttttttccctcgccccgtcccgcgcacgcacgcacgccgcagaggaggcaagcctgccgcagggtctccgcctagaggaggatgggatacgacggcgccccctcgcccgcatcggccgcggcgcgcgacgccaagaagaagaggggtaaccgctcgtcggccaagctgaagcagtgcaagctcgacgcgcgccgcgagcagtggctgtcgcaagtcaaggatgggaaggaggccacggccaagcctttgccagcgggcgcaggatcaggggcagggtcgaatgctgggtcgccaatccttgcgtcgccacaccctccactgccccggcggcgagccgatgcaaggtcaaggggtggggctctggaggacgacaaggaggatgctggcgctaccgggcaagaagtaggcggcagcgaccttgactcccctatgcacagcccttgttcagacaactctcgaggtggcggctgtgcacagagtaagcgctgctcaagcaatggtggtggccccagcctcagcagcgtgagcagtctatggtccagttccaggagtgtgagtgatgctgaggatgatgacacgggcagtggccctgaggaggaaaacggggtgctggatgattgggaagctgttgctgatgcactttcagtcgatgataacagtcattgccaccagagtttaggtaccacgatgcccccagcagctacaagtgagtcggcacctctggcaaatacatcaaaaagaacagagcctattcgtagcaatgcaagagcttggacaccagatgatacgttccgtccacagagcttgcccagtatctccaagcagtcgagcttcccagcgaggatcggcaactgctgggggatgggtatgagtgcagcacatcagagtatcctctctatgccattatcttgcccgatatgctacgaggatcttgacccaacagactcaagcttcctcccctacccttgcgggttccatctgtgtctcttctgccacaagaggatcctcgaggcggatgcgcgttgcccagggtgcaggaagctgtacaatgcagggtctgcaggagaaggaggagcgccagcaccagtgcgtctatcccgttcttgtagcatgggtccaagacactaggctgtgtgaaggctatgatagctctatgccgtagttctgctttgcatgttactgtcggatatgctggttttgttgcgtattgtctgcttttggtataaagaaatgtgaatatttgaacaaaaaaaaaaaaaaaa

SEQ ID NO: 5214 - protein, 348 aa, Triticum aestivum
  misc_feature: GI Number: 38347056; NR Description: OSJNBa0060P14.3 [Oryza
MGYDGAPSPASAAARDAKKKRGNRSSAKLKQCKLDARREQWLSQVKDGKEATAKPLPAGAGSGAGSNAGSPILASPHPPLPRRRADARSRGGALEDDKEDAGATGQEVGGSDLDSPMHSPCSDNSRGGGCAQSKRCSSNGGGPSLSSVSSLWSSSRSVSDAEDDDTGSGPEEENGVLDDWEAVADALSVDDNSHCHQSLGTTMPPAATSESAPLANTSKRTEPIRSNARAWTPDDTFRPQSLPSISKQSSFPARIGNCWGMGMSAAHQSILSMPLSCPICYEDLDPTDSSFLPYPCGFHLCLFCHKRILEADARCPGCRKLYNAGSAGEGGAPAPVRLSRSCSMGPRH

SEQ ID NO: 5215 - DNA, 1372 bp, Triticum aestivum
  misc_feature (1)..(1372): Ceres cDNA ID no. 22005643
  misc_feature (1)..(1372): Ceres CLONE  ID no. 861553
  misc_feature (1)..(1372): Also known as  Ceres CDNA ID no. 24357233
atatctaaaagttgcctagctacgagttgtagtagacccagagcctgattggattgtactagatgaagcctgcggtgagagctgaagacgaggcgatgagcacggaggagctgctccaagcccagacggatctctaccaccactccctagcctacatcaagtctatggcgcttggtgccgccacagaactcggcgtcgccgacgccatccacggccgtggcggtgccatcaccttgtctcaccttgcggccgcgaccggcgtccacccgacgaaagtccaacacttcgggcggctgatgcgcgcgcttaccgtcactggtgtcttcacctcggaggaaaaagaaggcggtggtggtgccctgtacaagctcactcggatttcacgcctccttgtcggagtcggcaagcgtcggctctccccgatggtgcgtatgcttgtcagcgaggtcagtttcaccactcccatgagcatctgcgagtggatcaccactgagacgccggctagggccatgttcgaggcccattttggctctacgcaaaatgggttgtgggagaaggaggacgcgtatggtgcccccttctactcagcaatgtctgcggacagccgtgtcgtcatggaggttctgctgagagagtgcagcagcgtctttgaggccgtcgccggctcacttgtcgatgtcggcggcggcagcggtggagtcgtggctgccgccatcgccacagcgttccctcacatcaagtgctccgtgctggacctccccaacgtggtagcagcggccgacgacaccagcaacgtgcagttcgtctccggcgatatgtttgactacattccaccagcggatgccgttctactcaagtggattctgcatgactgggaagaccaagactgcgtcaagatactgcgcaagtgcagagaggccatcaccacaagaggtgctggggggaaggtgattataatcgatttcgtcgtcggtgctggttcttccaaggagacggagacacaggttctgtttgatctttacatgatgatggagaatggggctgagcgggacgagcacgagtggagcaagattttctttgaagctggatttagcgactacaagatgatgccagtcttaggcgctcgttcactcattcaagtattcccatgaattccgggggtttcgtgtccaaatgtacttcccatttccaaatgtttgcttgctttcgaatcagaataatgcctaggactatactatatagtctcgactttgaagctgaataatgaaactgtttgttatcctatgtgttgttttcattcataattcatatgctcataattaaataaaggctgctatttttgtttaaaaaaaaaaaaaaaaaaaaaaaaaaa

SEQ ID NO: 5216 - protein, 362 aa, Triticum aestivum
  misc_feature: PFam Name: Methyltransf_2; PFam Description: O-methyltransferase
  misc_feature: PFam Name: Dimerisation; PFam Description: Dimerisation domain
  misc_feature: GI Number: 50253195; NR Description: flavonoid 7-O-methyltransferase-like [Oryza sativa (japonica cultivar-group)] >gi|50252861|dbj|BAD29092.1| flavonoid 7-O-methyltransferase-like
  misc_feature: GI Number: 55297348; NR Description: putative o-methyltransferase [Oryza sativa (japonica cultivar-group)] gi|55297295|dbj|BAD69125.1| putative o-methyltransferase [Oryza
  misc_feature: GI Number: 51535782; NR Description: putative O-methyltransferase [Oryza sativa (japonica cultivar-group)] >gi|51535174|dbj|BAD37886.1| putative O-methyltransferase [Oryza
  misc_feature: GI Number: 51451359; NR Description: putative o-methyltransferase ZRP4 [Oryza sativa (japonica cultivar-group)] >gi|46575944|gb|AAT01305.1| putative o-methyltransferase ZRP4
  misc_feature: GI Number: 51451358; NR Description: putative o-methyltransferase ZRP4 [Oryza sativa (japonica cultivar-group)] >gi|46575943|gb|AAT01304.1| putative o-methyltransferase ZRP4
MKPAVRAEDEAMSTEELLQAQTDLYHHSLAYIKSMALGAATELGVADAIHGRGGAITLSHLAAATGVHPTKVQHFGRLMRALTVTGVFTSEEKEGGGGALYKLTRISRLLVGVGKRRLSPMVRMLVSEVSFTTPMSICEWITTETPARAMFEAHFGSTQNGLWEKEDAYGAPFYSAMSADSRVVMEVLLRECSSVFEAVAGSLVDVGGGSGGVVAAAIATAFPHIKCSVLDLPNVVAAADDTSNVQFVSGDMFDYIPPADAVLLKWILHDWEDQDCVKILRKCREAITTRGAGGKVIIIDFVVGAGSSKETETQVLFDLYMMMENGAERDEHEWSKIFFEAGFSDYKMMPVLGARSLIQVFP

SEQ ID NO: 5217 - DNA, 1781 bp, Triticum aestivum
  misc_feature (1)..(1781): Ceres cDNA ID no. 22005644
  misc_feature (1)..(1781): Ceres CLONE  ID no. 861668
  misc_feature (1)..(1781): Also known as  Ceres CDNA ID no. 23721668
ttcttctcagcgagcaagcactcgccttcttgggatcccaaggtgacatcaccacgcgcccccatcctctcgccccccttgattcccgggaagcttcctgtcgccgtcgaccctccttcccagacttggcttagggtttctcaagattctggggctggcgggtgcaacggccagcgggggtgctttggtgaacggaacagggagcgtctgggttgaggtggatggaggggaggatgcaggggaaggtgcagcagctgtccgactccaaccgtcggatcatggaggccgatgcggcgccgccgcggcgcgtgtaccaggcgtggaaagggagcaatatattttttcttggagggagacttatttttgggcctgatgtgaggtcactcatagccacagtatgtttaattgtcatcccagtgatcatctttgctgccgttgtttctccacagcttgcccatgggtaccaaaatcaaattggaggttgggtggcatctgtatctatcatctttacagcatatattctcgttcttctgcttctcacgtctggacgtgatcctggaattgttccgcgtaattctcatcctccggaaccagaagacattggtgaatcctccaacttatcagattggccaggtggtcaacatggctcagctggtttaccactcaccaaggacgttattgtcaatggtgttttagttaaggtcaaatattgccatacatgtatgctttatcgtccaccaaggtgctcccattgctcaatctgcaataactgtgtcgaacgttttgatcaccactgtccttgggtagggcagtgtattggaaagagaaactaccgcttcttccttatgtttgtatcttcagcaactgtgctatgcatatacgtgttcacattctgctgggtcaacatcgggaaaataatggacacccatgagtgcacatttggtagagctatcttgaagtcgcccatctccgccattctcatgttatacacattcgttgctgtgtggtttgtcggaggattgacctcattccacctctacttgatttccaccaatcagactacttatgagaacttccggtaccgctacaataggagaagcaatccttacaaccgtgggctggtccaaaatttcatcgagatcctatgctcaaggattcccagctccagaaacaatttcagggctaaagctaacgaggattctgcagccttcgcctcaacacttagcatggggtgggtcctaagcccgccgaagatgagcgtggaccttgagatgggcacgaagaggcaagctgtgggtgcagaagacatggaggacttacacagccagattggcagttctatggggcttgagcgatgcggcacagaacccccacattttgtcggtcgaaagggttgctctgaaattgcatctgacatcgagacgtttgcagaagagtttggcatggacaacgagttcactgagaggaaaaagactgtgcggcatacaaatgataatccttaaggcacttacctcacaaaccctctatccctagctcagagcggcatagctcagaaagaaaaaaagaaagtagggcaaatggtagaacagattcgctattttggcttaatctaggtgttatttgtagatcaactgattagcaatataggcatgatggaacacgaattgatggaccagatggtttcactggatccatcttggtttagaatgggttgtactgctagtgatatggactgtacctgttaattcatatgttgtaggttgccaaaaaaaaaaaaaaaa

SEQ ID NO: 5218 - protein, 426 aa, Triticum aestivum
  misc_feature: PFam Name: zf-DHHC; PFam Description: DHHC zinc finger domain
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
  misc_feature: GI Number: 30688566; NR Description: zinc finger (DHHC type)
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 57900122; NR Description: putative zisp [Oryza sativa (japonica cultivar-group)] gi|57899394|dbj|BAD88041.1|
  misc_feature: GI Number: 30693084; NR Description: zinc finger (DHHC type)
MEGRMQGKVQQLSDSNRRIMEADAAPPRRVYQAWKGSNIFFLGGRLIFGPDVRSLIATVCLIVIPVIIFAAVVSPQLAHGYQNQIGGWVASVSIIFTAYILVLLLLTSGRDPGIVPRNSHPPEPEDIGESSNLSDWPGGQHGSAGLPLTKDVIVNGVLVKVKYCHTCMLYRPPRCSHCSICNNCVERFDHHCPWVGQCIGKRNYRFFLMFVSSATVLCIYVFTFCWVNIGKIMDTHECTFGRAILKSPISAILMLYTFVAVWFVGGLTSFHLYLISTNQTTYENFRYRYNRRSNPYNRGLVQNFIEILCSRIPSSRNNFRAKANEDSAAFASTLSMGWVLSPPKMSVDLEMGTKRQAVGAEDMEDLHSQIGSSMGLERCGTEPPHFVGRKGCSEIASDIETFAEEFGMDNEFTERKKTVRHTNDNP

SEQ ID NO: 5219 - DNA, 628 bp, Triticum aestivum
  misc_feature (1)..(628): Ceres cDNA ID no. 22005645
  misc_feature (1)..(628): Ceres CLONE  ID no. 863410
  misc_feature (1)..(628): Also known as  Ceres CDNA ID no. 25401086
agatcgaagacattggcggcggcggcggcaaatcgtctgaaccaggtttttgcatttgttgctatcttatggacgacaagagtaacgtgaagaaggaaatagatggctcccttgcgccccgtcctcgcaagggaggacttaaattcgcacccaaaaagcctccaaagaaacctgcaaaggttgtcccaaaagcggagcctgttgaggagagcaaggatgaaatcattgataaggaattgttgatgaaactgaagacatcacagagcactgatccctttggaagaagacctaaggttgagaaaaaagaaatcaatacacaggttgcatttgggcaagggaactcttcgtacgcaagaggtcaagtgctaatcgcactgtatgctaaaatctatgctgtcttcagtatttttgctcttatctatggttgtcagtcgactctccaatgttggtgtcagtaactgtcagatgttgagtgtcttgaaaactttctgataattgtgggatttgctttgtaatggtaatcgtgaaattggtgtggttgtgttttggttgaatcaagagattcagccctgttattctatcggattatcttgtgtcaaaaaaaaaaaaaaaaaaaaaaaaaaaaaaa

SEQ ID NO: 5220 - protein, 129 aa, Triticum aestivum
  misc_feature: GI Number: 50923907; NR Description: OSJNBa0072K14.7 [Oryza sativa (japonica cultivar-group)] gi|21740741|emb|CAD40550.1|
MDDKSNVKKEIDGSLAPRPRKGGLKFAPKKPPKKPAKVVPKAEPVEESKDEIIDKELLMKLKTSQSTDPFGRRPKVEKKEINTQVAFGQGNSSYARGQVLIALYAKIYAVFSIFALIYGCQSTLQCWCQ

SEQ ID NO: 5221 - DNA, 1022 bp, Triticum aestivum
  misc_feature (1)..(1022): Ceres cDNA ID no. 22005646
  misc_feature (1)..(1022): Ceres CLONE  ID no. 866264
  misc_feature (1)..(1022): Also known as  Ceres CDNA ID no. 24411349
ctttcccgtcaccacgccgcgcgcgccgcacacgtacgtacagacccaccaccccctctcttctcctctcagccaggcagccgcgctccccgcattgcattgacatggtctcgtcttgcctcgcctcgccggccactgcgcgcggcggctctgctctacgtctgcagcttcagccgagggggtgccgcgtgacgtgcttggccgacgcggggggagccgggagcggcggccgcgccaaggccgtgggaggattcgcgtgcggcttgctcgcagcctgggccgtcgcgtcagcccccagcccggtcatcgccgctggccagaggttgcctccactgtcaacagacccaaagagatgcgaggctgcatttgttgggaacacaattggtcaggcaaatggggtgtatgacaaggtgcttgatctccggttctgtgatttcacaaatgacaaagataatcttaaaggcaagactctgtctgcggctttgatgtcaggggcaaagtttgatggtgctgacttgacagaagttgtcatgtccaaggcctatgctgttggtgcaagtttcaaaggcacgaacttcacgaatgcagtgatagaccgtgccaattttggaaaagccgacctcgaaggtgcaatcttcaagaacaccgtcttgtcgggatcaaccttcgatgaagctaatatgaaggacgtcgatttcgaggacacactcattggctacattgaccttcagaagctttgcagaaacaccagcatcaatgaagacacaagattggagctgggatgcagatgattcaatcatagctgcacttatggcagcatcgacatccatcgtccggtaaagattagtaagtcaggtctgttatagagcaccagcaggatgacaacccccctcccccctctgaaaatatgtatgtacaagcttttgtataccgtaaatatcataccacagctgcacttgatctgtgcaaacacaacttacagcaaatgaaaaaccttatgcatttcaaaaaaaaaaaaaaaa

SEQ ID NO: 5222 - protein, 228 aa, Triticum aestivum
  misc_feature: PFam Name: Pentapeptide; PFam Description: Pentapeptide
  misc_feature: GI Number: 30696347; NR Description: thylakoid lumenal 17.4
  misc_feature: GI Number: 23129920; NR Description: COG1357: Uncharacterized
  misc_feature: GI Number: 23128670; NR Description: COG1357: Uncharacterized
  misc_feature: GI Number: 46135262; NR Description: COG1357: Uncharacterized
  misc_feature: GI Number: 48892495; NR Description: COG1357: Uncharacterized
MVSSCLASPATARGGSALRLQLQPRGCRVTCLADAGGAGSGGRAKAVGGFACGLLAAWAVASAPSPVIAAGQRLPPLSTDPKRCEAAFVGNTIGQANGVYDKVLDLRFCDFTNDKDNLKGKTLSAALMSGAKFDGADLTEVVMSKAYAVGASFKGTNFTNAVIDRANFGKADLEGAIFKNTVLSGSTFDEANMKDVDFEDTLIGYIDLQKLCRNTSINEDTRLELGCR

SEQ ID NO: 5223 - DNA, 1648 bp, Triticum aestivum
  misc_feature (1)..(1648): Ceres cDNA ID no. 22005648
  misc_feature (1)..(1648): Ceres CLONE  ID no. 878674
  misc_feature (1)..(1648): Also known as  Ceres CDNA ID no. 24410975
acaactactcctacaagctagcacccggaaaagcaagcaagcaagaaagaaagaacaatatgcctgagcttctccggacgcttaccgctgggcgacgccgcctcttgctggtgctgcagctcgttcccggcctcctgcttctgctgctctcgcgcttgacatcggcgtcggcgtcgacggtggtcacccacctgccaggattcgatggccctctccccttctacctcgaaaccggatacgtgggcgtggaagaggagaccggggcggagctcttctactacttcgccgagtcggagcggagccccggcacggaccccgtcatcctttggctcaccggcgggcctcgctgctcaggcttcagcggcttcgccttcgaagttggtccggtaaagtatgtgctggcaccgtacactggcggtttgccgcagctggtacataacccgctgtcatggaccaagatggcgagcatcatcttcctggattcgccggtctgctcgggcttctcgcatgctcgtgaccccaaaggctgcgatgtcggagactactcgtcctctctgcaagtccaaagattcctgaataagtggttcactgatcacccacagtaccatgcaaatcctttctaccttggaggagattcatacgcgggaaaggtgattccgcttattgcacactacatgttacaaggaactgaaaaaagggagcagcctcttattaatctcaagggctacctgatcggcaatcctgtaacagacccaaagttcgataaaaatttccaagttcaaggggctcatggctttgggataatatctgaccaaatatatgaggctgcagtgaagaactgcaaaggaaattatgtaaaccccgcgaatcaactgtgtgctgaggtgctagaaactgtagacagtctcatttctgaaatcgcagatgcacacgtcctttataaaaaatgtgtcgtcgccacgccaaagcccatagatgatgctataagaagaaaatttctgctagaagaatcaattgagccaaatgaagcgcctggtcgacctaccatcgattgttttacatacggttactacctggcatacttctggatgaacaacaggatgactagagatgctctcgggatcaaggggggaacagttggcgagtgggtgagatgcaaaaaagaactcccctacacacaggacatgccaagcagcataccgtaccatcttaatctcaccacgagaggttaccgtgcactcgtatacagcggagaccatgatctccaggtgcctcagctcagcacgcaggcgtggataagatctttgaacttctccatcggcgatgactggagggcatggcatctcgatggccaggctgcaggatttaccatcacatatgcaaataacttgacctttgcaacagtaaagggtggaggtcatactgctccagagtaccagcctgaagaatgctttgccatggcccaaaggtggcttgacaacaagccactctgatactttgacaacacaaaattttctctcttaacacaaatccttttatatttaatttgcttctttcaacctgtaaagatgcagtcaacagtgatgtaaaaaaatagtgatgtatatcaaacagaattatttttctctccataaaaaaaaaaaaaaaa

SEQ ID NO: 5224 - protein, 477 aa, Triticum aestivum
  misc_feature: PFam Name: Peptidase_S10; PFam Description: Serine
  misc_feature: GI Number: 50918449; NR Description: putative serine carboxypeptidase [Oryza sativa (japonica cultivar-group)] >gi|28273383|gb|AAO38469.1| putative serine carboxypeptidase [Oryza
  misc_feature: GI Number: 50911603; NR Description: putative serine carboxypeptidase [Oryza sativa (japonica cultivar-group)] >gi|41052788|dbj|BAD07656.1| putative serine carboxypeptidase
  misc_feature: GI Number: 62701917; NR Description: Serine carboxypeptidase
  misc_feature: GI Number: 50918441; NR Description: putative serine carboxypeptidase I [Oryza sativa (japonica cultivar-group)] >gi|28273379|gb|AAO38465.1| putative serine carboxypeptidase I
  misc_feature: GI Number: 15418807; NR Description: sinapoylglucose:choline
MPELLRTLTAGRRRLLLVLQLVPGLLLLLLSRLTSASASTVVTHLPGFDGPLPFYLETGYVGVEEETGAELFYYFAESERSPGTDPVILWLTGGPRCSGFSGFAFEVGPVKYVLAPYTGGLPQLVHNPLSWTKMASIIFLDSPVCSGFSHARDPKGCDVGDYSSSLQVQRFLNKWFTDHPQYHANPFYLGGDSYAGKVIPLIAHYMLQGTEKREQPLINLKGYLIGNPVTDPKFDKNFQVQGAHGFGIISDQIYEAAVKNCKGNYVNPANQLCAEVLETVDSLISEIADAHVLYKKCVVATPKPIDDAIRRKFLLEESIEPNEAPGRPTIDCFTYGYYLAYFWMNNRMTRDALGIKGGTVGEWVRCKKELPYTQDMPSSIPYHLNLTTRGYRALVYSGDHDLQVPQLSTQAWIRSLNFSIGDDWRAWHLDGQAAGFTITYANNLTFATVKGGGHTAPEYQPEECFAMAQRWLDNKPL

SEQ ID NO: 5225 - DNA, 1594 bp, Triticum aestivum
  misc_feature (1)..(1594): Ceres cDNA ID no. 22005649
  misc_feature (1)..(1594): Ceres CLONE  ID no. 883737
  misc_feature (1)..(1594): Also known as  Ceres CDNA ID no. 24411241
gcaagaggatccggtccggaaaggacacagtgctctgttcctgcacgggacagcgcggtcgccgccagcgtcgccttctcttctctgcggcactgtccgccgcggaccctcgtcctccagaattccccggggtagcaaggagagggccagaggcggagcagccgcagcggccagcggcggagacgcggcgacgcgaggcaagaagagatggagtaccgcaacaagatggtgctcgcgcccatggtccgcgcgggtactctgccgtttaggctattggctgctgaatatggcgcggatattacgtacggagaagaaataatagatcataagtttgtgaactgtcaacgcgttataaatgaatctcttgggacaactgattttgtggagagagggactgatagtgttgttttccgaacatgcccgcaagaaagggacaaggttgtctttcaaatcggcacgtcagatgctgtgagagcacttaaagctgctgagattgtgtgtaatgatgtcgctgctatagatatcaacatgggttgtccaaaggctttttctgtcagtggaggaatgggttctgcattactctccaaacctgagcttatacatgatattttgaccacattgtggaggaacttgaacacaccagtgacatgtaaaatccgtctactgaacacacgtcaggacactgtggaattggcacgccggattgagaaatgtggtgttccagctctggctgtccatggaagaaaggtcaaagacaggccaagggatccggctaagtgggatgagattgctgatgttgtatccgcactgtcaattccagttatagctaatgggaatgtatttgagtacgaagattttaagagaatcaaagatgctacaggtgccacatctgtaatggctgctagaggtgccttgtggaatgcctccattttctctgctaaaggcaaagtaccttgggaggatttcaaaagagagtatgtgagaaagactattttgtgggacaacgatattaagagcacaaagacaacgctaagagaaatcataatgcactacatttgccttgaagggactgaagggaaaggtgtgataaagtgtggttcgtcagcagatgtagcgagactttacggggaagaggattactataattttgttgtttcaaataggaaatgaaaaaaacaggattttgctaacctctatgtgacccagcttctgcttggatccctcggttggttttatgaatgttttctccggagatctttggatgagttttggagaaattcacatatcaccaaagaagagtgcagttttggcttttgcactgtgccatcatggtatctgatcaagatcaactgaggattcatggattccttatttcgtggggtacagttttgcgccgtgttcttataggattttttttgacaaaaaaggccgttgatttagactgacaagaatctagaagcattttgagatactgtattctttccattactgacaaaatatataatccatgacttgctgatagacaccatttctgtaagcttacatatattttagttattctgccaatctggatcgctcaaaaaaaaaaaaaaaa

SEQ ID NO: 5226 - protein, 320 aa, Triticum aestivum
  misc_feature: PFam Name: Dus; PFam Description: Dihydrouridine synthase (Dus)
  misc_feature: GI Number: 62859019; NR Description: LOC548984 [Xenopus tropicalis]
  misc_feature: GI Number: 48097296; NR Description: similar to CG1434-PA
  misc_feature: GI Number: 66519332; NR Description: PREDICTED: similar to
  misc_feature: GI Number: 31219672; NR Description: ENSANGP00000010262 [Anopheles gambiae] >gi|21299920|gb|EAA12065.1| ENSANGP00000010262
  misc_feature: GI Number: 17863006; NR Description: SD08006p [Drosophila
MEYRNKMVLAPMVRAGTLPFRLLAAEYGADITYGEEIIDHKFVNCQRVINESLGTTDFVERGTDSVVFRTCPQERDKVVFQIGTSDAVRALKAAEIVCNDVAAIDINMGCPKAFSVSGGMGSALLSKPELIHDILTTLWRNLNTPVTCKIRLLNTRQDTVELARRIEKCGVPALAVHGRKVKDRPRDPAKWDEIADVVSALSIPVIANGNVFEYEDFKRIKDATGATSVMAARGALWNASIFSAKGKVPWEDFKREYVRKTILWDNDIKSTKTTLREIIMHYICLEGTEGKGVIKCGSSADVARLYGEEDYYNFVVSNRK

SEQ ID NO: 5227 - DNA, 1158 bp, Triticum aestivum
  misc_feature (1)..(1158): Ceres cDNA ID no. 22005650
  misc_feature (1)..(1158): Ceres CLONE  ID no. 885405
  misc_feature (1)..(1158): Also known as  Ceres CDNA ID no. 24437349
atcttttgatcatatactggtcaatggctaaaggccctccatattatagtcttgcagtgtaccaaagagcccaaaaggtgagtgtgtttattactggattttgttccagtatttttggtgtgatcagctttgtgggtttatttacgtctgcatgccatcggcttgtatctgcctaagctgtaattcagaccttttgtattaactattacttatttggcagagcttgagatggattttccaaagatgtccgaaaatgaagaattggggcgcctgatcactccacacgaggcctgcaatcgaattgctgaggttgtccaagaggctgtcagaaagatggagaccgtggctgaagagaagatgcagatgttcaagaaggctcgcctcgcggtggattcctgcgagcgtgagctggaggagaagacacgggaggcacgggagctcaaggcggagcagctgcgtaagcagcagcaggtggaggagctggagagcatgatccggctgaagtgtgctgaggccgagatgttccagctgaaggccaacgaggcccggcaggaggcagaacagctccagagcattgcattggccaagtcggagaaggcggagcaggactatgcgagcatgtacctcaggcgccgcctggaggaggccgaggcagagaagcagtacatctttgagaagatcaagctgcgggagaacccgaggccgctggcaacggtgcctccccaggcgagcagtagtgctgccaccgcggcccccacccctggcgactcatcagatatgatgatgctgtccaagatccaggacctgctgaagaacgtccgcagcatgccgtctggcaagtcggacgtgcggcagtcgaaatagccggtgatgcgtgtttcatgggtgatactttctgccatgtaaattgaactatgcgtctcatgatgtttctttattagttgctgcatagttatactgaattgcattgtcgtatatttgccgttgttgtaatgtaaacttagtttcataatgacaatgggggctaaaacaaaccaaatacgccatatctctatatactagagtgataggcgagctttgttgtgcccgttgattggtgtgatgattttatcaagcatatgcagtaaccgttgtgatgatctttaaaaaaaaaaaaaa

SEQ ID NO: 5228 - protein, 211 aa, Triticum aestivum
  misc_feature: PFam Name: TolA; PFam Description: TolA protein
  misc_feature: GI Number: 30385713; NR Description: Potyvirus VPg
  misc_feature: GI Number: 30385711; NR Description: Potyvirus VPg
  misc_feature: GI Number: 33339558; NR Description: ABRH1 [Marsilea quadrifolia]
MDFPKMSENEELGRLITPHEACNRIAEVVQEAVRKMETVAEEKMQMFKKARLAVDSCERELEEKTREARELKAEQLRKQQQVEELESMIRLKCAEAEMFQLKANEARQEAEQLQSIALAKSEKAEQDYASMYLRRRLEEAEAEKQYIFEKIKLRENPRPLATVPPQASSSAATAAPTPGDSSDMMMLSKIQDLLKNVRSMPSGKSDVRQSK

SEQ ID NO: 5229 - DNA, 1455 bp, Triticum aestivum
  misc_feature (1)..(1455): Ceres cDNA ID no. 22005651
  misc_feature (1)..(1455): Ceres CLONE  ID no. 887833
  misc_feature (1)..(1455): Also known as  Ceres CDNA ID no. 24404393
acaccgaaacctgcctatccatcgctaccaatacacgaccgaccacctagcagtagctagcgtgctgcaactttgtgtgacagtcagatcagatggcctcgccggctcttctccgctacctggttgtgctactcctcctagtaggctgcctcgggtggcccgtcccacctcctccgaggatggtcgatggcatcacggccatatacaacttcggggactccatatcggacaccgggaacttcatccgggaaggcgccgtcgggctgatggagcacaccgggaagctcccctacggctccgccatcggcggccccaccggccgatgctccgacggctaccttatgatcgacttcctcgcccaggatcttgggctgccgttgctgagcccgtacctcgacaagggcgccgacttcacgcacggcgtcaacttcgccgtcacgggcgccaccgccctcgacacggcggcccttgccaggataggggtcaacatgacacacaccaacagctccctcgctgtccagctccaacggttcaaggatttcatggccagcacctccaaaaccccctcagaggcgcgcgagaagctggcgagctcgctggtcctggtcggagagatcggcgggaacgactacaactacgccttcgccatgaacagccctcagcccaacggcggcctcaacaacatcgggcgcatgataaccggcgcggtggagtcgctggcccttgtcccgcaggtcgtcaggtccatcacgggcgcggccaaggagctgctcgacatgggcgccacgcgggtggtgatcccgggcaacttcccgctcggctgcgtgccgagctacctccacgccgtgaacgagacggaccgggcggcatacgacggcaacggctgcctcatcgggctcaacctcttcgcgcagatgcacaacgtgctgctgctgcagggcatccgggagctgcgccagctctacccgtccacgaccatcgcctacgccgactacttctcggcctacgtgcagatgctgaggggcgcgtccaagatgggattcgacgcggcggccgcgaccaaggcgtgctgcggcgcgggcggcggcgcgtacaacttcgacatggacaggatctgcggcgcgccggggacggcggtgtgcgcgaggccggaagagtaccttagctgggacggcgtccacctgacgcagcatgcctacaaggtcatgaccgagctgctctaccaccgaggcctcgcgtctcctgcgccggtgaatttcccgcgcatgtagatcgcctgtggttggtttcgagtttcgacactttcaaagtgttcgccccgccgtttgtattttattttccttttcgagtcttgtggagtgtggacggtagtttggtgttgatgtatgtaagaacttttgtggcggcacatgaatggaagaaataacatgtgattgtgcaaaaaaaaaaaaaaaa

SEQ ID NO: 5230 - protein, 392 aa, Triticum aestivum
  misc_feature: PFam Name: Lipase_GDSL; PFam Description: GDSL-like
  misc_feature: GI Number: 50910333; NR Description: putative lipase [Oryza sativa (japonica cultivar-group)] >gi|47496835|dbj|BAD19595.1| putative lipase [Oryza sativa (japonica cultivar-group)] >gi|47497950|dbj|BAD20155.1| putative lipase [Oryza sativa
  misc_feature: GI Number: 50910239; NR Description: putative lipase [Oryza sativa (japonica cultivar-group)] >gi|47497315|dbj|BAD19357.1|
  misc_feature: GI Number: 53792843; NR Description: putative lipase [Oryza
  misc_feature: GI Number: 7406408; NR Description: lipase-like protein [Arabidopsis thaliana] >gi|11358488|pir||T48425 lipase-like protein - Arabidopsis thaliana >gi|15237586|ref|NP_196018.1| GDSL-motif
  misc_feature: GI Number: 54290849; NR Description: lanatoside 15'-O-acetylesterase-like [Oryza sativa (japonica cultivar-group)] gi|54290275|dbj|BAD61220.1| lanatoside 15'-O-acetylesterase-like
MASPALLRYLVVLLLLVGCLGWPVPPPPRMVDGITAIYNFGDSISDTGNFIREGAVGLMEHTGKLPYGSAIGGPTGRCSDGYLMIDFLAQDLGLPLLSPYLDKGADFTHGVNFAVTGATALDTAALARIGVNMTHTNSSLAVQLQRFKDFMASTSKTPSEAREKLASSLVLVGEIGGNDYNYAFAMNSPQPNGGLNNIGRMITGAVESLALVPQVVRSITGAAKELLDMGATRVVIPGNFPLGCVPSYLHAVNETDRAAYDGNGCLIGLNLFAQMHNVLLLQGIRELRQLYPSTTIAYADYFSAYVQMLRGASKMGFDAAAATKACCGAGGGAYNFDMDRICGAPGTAVCARPEEYLSWDGVHLTQHAYKVMTELLYHRGLASPAPVNFPRM

SEQ ID NO: 5231 - DNA, 1344 bp, Triticum aestivum
  misc_feature (1)..(1344): Ceres cDNA ID no. 22005652
  misc_feature (1)..(1344): Ceres CLONE  ID no. 890267
  misc_feature (1)..(1344): Also known as  Ceres CDNA ID no. 24410911
acagtgatgcaaccatagacctaccaatgcccaaggaaagcattccccctccagatctccatggcataaaccccatcagaaactcgagcaaaaaatttcctggtggaagaaaacttgcgctgatactaagcgcagtcgtattcgtccttgtttcctcgacatattatcctgagcatgttttctatggcgctagagagccagctcataattctcagcagacggccatcgccggtcacgaagacaatgaaatagactgcaatctgttcaatggcacatgggtcagggatttgggaggcccaatctacaccaacatgacatgcccgacgataccagattcaaagaactgcgcaaagtatggaaagccaatggattatgtaaactggaggtggaagccacatggctgtgatatggcaaggtttcaacctcagctattcttaaaaattgtccaagggaagacattggctttcgccggggattcaattggacggaaccagatggagtcactcctctgtttattgtcacaggtagaagctccaacaaaagttcacagcgacactaaagataaatttatcacatggaacttcagatcttataacttcactctcatggcactgtggacaaaatttctagtagaagattctcaaagagagatcaacgggacattagttgaatcgcatgatatgcacttagataaacttgatgcaagattagctgcaaaattgcatgagatcaatatcttaattgtatctagttcacgttggttcttcagaaaaaattatctgtacgaagatgggaaactaatcggttgcatatactgctcagaggataacatcacaaatttcagcgtcatttcagctattcagagggtgtttaggacggctatcagtaacttgaatagccgccgagaatccagattgcagttaacagtggtgaggacagcaacatcggcacattttgaaaatggccagtggaatactggaggaacatgcaacagaactgaaccactaggagaaagaacagcaatgaccagtacaattgaaagggaaataagagatgtccaggttgaggaagccaacagagcacaaaaggagaaaaaacaaaagggcgggatgaatatagagatcctagatataaccaagcttatgtctatgagacctgatgcacacccagggatccactggaataatgagtggatgaggggttacagtgactgttcgcattggtgcctgccaggaccaattgatatgtggaatgagctattacttgctgtgctttccaaatataagaaaaacgtggaagaccaatgatgcaggaacttctgctaatccaaaaaaaaaaaaaaaa

SEQ ID NO: 5232 - protein, 426 aa, Triticum aestivum
  misc_feature: GI Number: 51535836; NR Description: leaf senescence protein-like [Oryza sativa (japonica cultivar-group)] >gi|51535116|dbj|BAD37779.1| leaf senescence protein-like [Oryza
  misc_feature: GI Number: 51535834; NR Description: leaf senescence protein-like [Oryza sativa (japonica cultivar-group)] >gi|51535114|dbj|BAD37777.1| leaf senescence protein-like [Oryza
  misc_feature: GI Number: 51535835; NR Description: leaf senescence protein-like [Oryza sativa (japonica cultivar-group)] >gi|51535115|dbj|BAD37778.1| leaf senescence protein-like [Oryza
  misc_feature: GI Number: 55296963; NR Description: leaf senescence
  misc_feature: GI Number: 50912375; NR Description: leaf senescence protein-like [Oryza sativa (japonica cultivar-group)] >gi|46390842|dbj|BAD16346.1| leaf senescence protein-like [Oryza
MPKESIPPPDLHGINPIRNSSKKFPGGRKLALILSAVVFVLVSSTYYPEHVFYGAREPAHNSQQTAIAGHEDNEIDCNLFNGTWVRDLGGPIYTNMTCPTIPDSKNCAKYGKPMDYVNWRWKPHGCDMARFQPQLFLKIVQGKTLAFAGDSIGRNQMESLLCLLSQVEAPTKVHSDTKDKFITWNFRSYNFTLMALWTKFLVEDSQREINGTLVESHDMHLDKLDARLAAKLHEINILIVSSSRWFFRKNYLYEDGKLIGCIYCSEDNITNFSVISAIQRVFRTAISNLNSRRESRLQLTVVRTATSAHFENGQWNTGGTCNRTEPLGERTAMTSTIEREIRDVQVEEANRAQKEKKQKGGMNIEILDITKLMSMRPDAHPGIHWNNEWMRGYSDCSHWCLPGPIDMWNELLLAVLSKYKKNVEDQ

SEQ ID NO: 5233 - DNA, 1105 bp, Triticum aestivum
  misc_feature (1)..(1105): Ceres cDNA ID no. 22005654
  misc_feature (1)..(1105): Ceres CLONE  ID no. 891994
  misc_feature (1)..(1105): Also known as  Ceres CDNA ID no. 24410923
actcaaacggtcaatcggtccaacctgcagctacgtaggtgcaaccgccggccatgggcggcacgccgcggagcagcatcggccacatcctgcccggcgccggcttcttcaccgtcggcctgtggcacctgttcaaccacattaggctcttctcccagcgcccggactcctacgtcgcgccggtgtggttccccgtgccgcgcgcgcgctacctcgagcccgccctcgtcatcgccggcagcgccctcgagttcgtcatggagatgttcgtggaccactccaccttcctgccgttcgacgccgacggctccatcccgtcggaccgcctccacaaccacgagcacgccatcatctgcctggccctcatcgtctacgcgggcggcgccgtccacctggaccgcgctcgggctccggggcgccgcgcgctctgcctgctgctcgtgtcggtggtgttcgcgcaggagctcctcgtattccacttccactccaccgaccacgccggcgtcgagggccagttccactggatcctccaggtggtcgtcgcggcgtgcctcggcaccgcgctcctcggcgtcggcttcccgcggagcttcgcggtgagcctggcccggtcggcgtgcatcatgttccacggggtgtggctggcggtcatcggcgccatggtgtgggtgcccagcatggtgcccaaggggtgctcgctggtgcgcgaggacggccgcgacacggtgcgctgccacagcaaggccagccttcaccgcgccagggcgctcgtgaacctgcagttcgggtggtacctgtccttcatgaccgtgctcgtcctcgcggtctatctctacgtttgcagcaaataccccgccgaccaaccgtacgcgcggctcctccggaaagccggcgacgaggaggaagagcatgacctagaggcgcgcaagtgcggggtgccgcgtgacggcggcagcgacgtgcatgcgcgtggcttcgcgccactggagatccaggtgtaaatgtgtcaagctgtagctagagtccccgcagatgcattgtactacagtgcttgtctgaatgttatctatctacgaatatccatggaccaaaaaaaaaaaaaaaa

SEQ ID NO: 5234 - protein, 315 aa, Triticum aestivum
  misc_feature: PFam Name: FH2; PFam Description: Formin Homology 2 Domain
  misc_feature: PFam Name: 7tm_1; PFam Description: 7 transmembrane receptor
  misc_feature: PFam Name: Cation_efflux; PFam Description: Cation efflux family
  misc_feature: GI Number: 51536142; NR Description: plant viral-response
  misc_feature: GI Number: 51536143; NR Description: plant viral-response
  misc_feature: GI Number: 51536144; NR Description: plant viral-response
  misc_feature: GI Number: 21618061; NR Description: unknown [Arabidopsis thaliana]
  misc_feature: GI Number: 50946573; NR Description: plant viral-response family protein-like [Oryza sativa (japonica cultivar-group)] >gi|42409056|dbj|BAD10308.1| plant viral-response family protein-like [Oryza sativa (japonica cultivar-group)]
MGGTPRSSIGHILPGAGFFTVGLWHLFNHIRLFSQRPDSYVAPVWFPVPRARYLEPALVIAGSALEFVMEMFVDHSTFLPFDADGSIPSDRLHNHEHAIICLALIVYAGGAVHLDRARAPGRRALCLLLVSVVFAQELLVFHFHSTDHAGVEGQFHWILQVVVAACLGTALLGVGFPRSFAVSLARSACIMFHGVWLAVIGAMVWVPSMVPKGCSLVREDGRDTVRCHSKASLHRARALVNLQFGWYLSFMTVLVLAVYLYVCSKYPADQPYARLLRKAGDEEEEHDLEARKCGVPRDGGSDVHARGFAPLEIQV

SEQ ID NO: 5235 - DNA, 1668 bp, Triticum aestivum
  misc_feature (1)..(1668): Ceres cDNA ID no. 22005655
  misc_feature (1)..(1668): Ceres CLONE  ID no. 892645
  misc_feature (1)..(1668): Also known as  Ceres CDNA ID no. 24410915
aaaaccaccacaacgatcgagcaagcaagccatcgatcccaccgcctccacaggagggtacgcaccactctcacaagcacaagcacacacgaacctcctaccaccatggtgaccttcacggcgcgccggggcgagccggagctggtgcgcccggcgaggccgacgccgaccgagaccaaggcgctctccgacctcgacgaccagtggacgctgcggttctacgagtccatcgtcggcttcttccgtgccccgccgggcgaggcgcccaggctgggcaaggtggccaggggcatcaaggcggccgtggcggcggcgctggtgtactactaccctatggccggccgcctgcggaagctccccggcgggaataggctggcggtggactgcaccggggaaggagtggccttcgtggaggcctccgcggacgtgcggctcgaggacctcggccagccgctggtgccgccgtacccgtgcgtcgaggagttcctcggagactgcggtgacaccagggatgtacttggcaagcctttgctcttcctgcaggtgacacaactaaaatgtggaggatttgttattgggcttcacatgtgtcattgcattgcagatggttttggtattcttcaatttatcaaaactatagccgattttggatgcggtgaacttatcccaaccactttgcccgtgtggaaaagagatatcttcacagcacgcatgccaccatccattgcacatgtttacccggcatataaaccatttcttcatgggttagagtgcacgggagatgacgtgatgctatcaactccgccaaaatgcatggaagtgcaatatttattctttgggccaaatgagatagatattttgagaagccatgtcccagaacacctctctaaatctactacaacatttgagttgattacggttgtcatgtggcggtgccgcacattggcactgggctatgaatctactcaaaaagttcgtgtcatgtttacactaaatacacgtgggagaagcattaatggtgaaagcgctgtcccacgtggttactatggaaatgcacatttctctcctatggtcgaggtcaccgtcgaggagttggctacaaagccgctcggacatatacttgagctcatgcgcaaagtcaagttggacaccacaaaggatcgcatgaagtcaatggtggatttgatggcattatggcgagagcggtcacctttcggtatggatagaacatatgaggtcagtgacacaaagtgggttggaggcaatgcactgcaatttgggaaagctgagctggttgctgctggcacaccgcatgctggagatttcacttcaaaactgataagctatcataccaagtgtaagaataaagatggtgaagactcaaccgtggtatcaatcctactgccaaaaccagcaatggataagttcacaaaggagatggcattttggctgaagaagtaaaatggaaataacataacaagtccactttgttgtatgtatatgttatttccttcatttagtattacggtctaaacaccaaccatagttgattatgtgctaccatgaaagtcatggtgtacttgtttcaatgcttgtatcctcacttatgttttccccaatttattaagcaaatataaagaataattcctcccaaaaaaaaaaaaaaaa

SEQ ID NO: 5236 - protein, 451 aa, Triticum aestivum
  misc_feature: PFam Name: Transferase; PFam Description: Transferase family
  misc_feature: GI Number: 50936391; NR Description: putative benzoyl coenzyme A [Oryza sativa (japonica cultivar-group)] >gi|29027875|dbj|BAC65990.1| putative benzoyl coenzyme A [Oryza
  misc_feature: GI Number: 50917437; NR Description: putative hypersensitivity-related protein [Oryza sativa (japonica cultivar-group)] >gi|41469172|gb|AAS07101.1| putative hypersensitivity-related protein [Oryza sativa (japonica
  misc_feature: GI Number: 51556912; NR Description: benzoyl-CoA:benzyl alcohol/phenylethanol benzoyltransferase; BPBT [Petunia x hybrida] >gi|49798480|gb|AAT68601.1| benzoyl coenzyme A: benzyl alcohol
  misc_feature: GI Number: 62734352; NR Description: Transferase family
  misc_feature: GI Number: 1171577; NR Description: hsr201 [Nicotiana tabacum] >gi|7489142|pir||T03274 hsr201 protein,
MVTFTARRGEPELVRPARPTPTETKALSDLDDQWTLRFYESIVGFFRAPPGEAPRLGKVARGIKAAVAAALVYYYPMAGRLRKLPGGNRLAVDCTGEGVAFVEASADVRLEDLGQPLVPPYPCVEEFLGDCGDTRDVLGKPLLFLQVTQLKCGGFVIGLHMCHCIADGFGILQFIKTIADFGCGELIPTTLPVWKRDIFTARMPPSIAHVYPAYKPFLHGLECTGDDVMLSTPPKCMEVQYLFFGPNEIDILRSHVPEHLSKSTTTFELITVVMWRCRTLALGYESTQKVRVMFTLNTRGRSINGESAVPRGYYGNAHFSPMVEVTVEELATKPLGHILELMRKVKLDTTKDRMKSMVDLMALWRERSPFGMDRTYEVSDTKWVGGNALQFGKAELVAAGTPHAGDFTSKLISYHTKCKNKDGEDSTVVSILLPKPAMDKFTKEMAFWLKK

SEQ ID NO: 5237 - DNA, 1625 bp, Triticum aestivum
  misc_feature (1)..(1625): Ceres cDNA ID no. 22005659
  misc_feature (1)..(1625): Ceres CLONE  ID no. 906734
  misc_feature (1)..(1625): Also known as  Ceres CDNA ID no. 24411261
gtgtgattaacaaaccggtcgctcacatcttgccaccggtgctactaagtagtactaacgatggggtcgttcacgaacgccggctccgcgccagccccatccgcggcgaggccgcacgtcgtgctgctggccagtcccggcgccggccacctcataccgctggccgagcttgcgcggcggctcgtggagcaccacggcttcgcagccacgatcgtcaccttcagcggcctctccgactcagaagccctccccagcggcatccttgactccgcctccaccgttgcgctccctgccgtcaagatcgacgacctccccgccgacgccctccgcggcagcctgctcgtggagcttattcagcgctccctcccaagcctcggcaccctgctccgctccatgggctccaccaccccgctcgccgcgctggtgccggattttttctgctccgcggcgctgcccctcgccgtcgagctcggcgtcccgtgctacgtcttcgtccccagcagcctcaccatgatctacctgatgcgccgcatcgtggagctccacgacgacgcggcccctggcgaataccgcaacctcccggagcctctcgagatccccgggggcttgtcgctgcgccgcgcagagcttccggtcccgtatcgcgactgcaacggtctggcttacgcgcaactgctccggggaggccggcgataccgccgtgccgacggtttgttgatgaacaccttctacgagatggaacctgccatggtggaagagttcaggcaggcggcggagcaaggcacgttcccaccggcgttccccgtggggccgttcgtcctgtcaaactccgacgaggaaaccggcgcgtcggccatcctagagtggctggaccgccagccggcaaggtcggtggtgtacgtcgcgttcggaagcggcggagcgctgtctgtggagcagacggccgagctcgccgccgggctagaggcgagcagccagaggttcctctgggtggtgcggatgccgagcctggatggccgcacgtgtgtcttcgggaccggcggcggcgacgacgacccgttggcgtggcttcccgagggcttcctggagaggacgaggggcagaggcctcgccgtgccggcctgggtgccgcaggtgcgcgtcctgtcccacccggcgacggcgatcttcgtgtcgcactgcgggtggaactcggtgctggagagcgcggcgtccagcgtgccgatggtcgcgtggccgctttacgcggagcagaggatgaacgccgctctgctggaaggggccctcggggtggcgctgcggtcgagggcgcgagaggacggcggcgccgtggcgcgcgaggaagtcgcggccgcggtgaacgagctcatggagggggagaatggactcgtcgtgcggcgccgggccgaggacctgcagcgagcggcggcacgcgcgtggtcgccggatggttcgtcccgccgggcgctggaggatgtcgccgccaagtggagggcggcgcttggcgcgggcagttgaggcacgtacactcgtgactgcacgaactgcgcatggcacccccctgccagttcatttcgaattttattagtaaccagtaataatcctgatgaaaaaaaaaaaaaaaa

SEQ ID NO: 5238 - protein, 485 aa, Triticum aestivum
  misc_feature: PFam Name: UDPGT; PFam Description: UDP-glucoronosyl and
  misc_feature: GI Number: 50252251; NR Description: putative Hydroquinone
  misc_feature: GI Number: 50252256; NR Description: putative Hydroquinone
  misc_feature: GI Number: 50252246; NR Description: putative Hydroquinone
  misc_feature: GI Number: 50252240; NR Description: putative Hydroquinone glucosyltransferase [Oryza sativa (japonica cultivar-group)] >gi|50251521|dbj|BAD28882.1| putative Hydroquinone
  misc_feature: GI Number: 50252241; NR Description: putative Hydroquinone glucosyltransferase [Oryza sativa (japonica cultivar-group)] >gi|50251522|dbj|BAD28883.1| putative Hydroquinone
MGSFTNAGSAPAPSAARPHVVLLASPGAGHLIPLAELARRLVEHHGFAATIVTFSGLSDSEALPSGILDSASTVALPAVKIDDLPADALRGSLLVELIQRSLPSLGTLLRSMGSTTPLAALVPDFFCSAALPLAVELGVPCYVFVPSSLTMIYLMRRIVELHDDAAPGEYRNLPEPLEIPGGLSLRRAELPVPYRDCNGLAYAQLLRGGRRYRRADGLLMNTFYEMEPAMVEEFRQAAEQGTFPPAFPVGPFVLSNSDEETGASAILEWLDRQPARSVVYVAFGSGGALSVEQTAELAAGLEASSQRFLWVVRMPSLDGRTCVFGTGGGDDDPLAWLPEGFLERTRGRGLAVPAWVPQVRVLSHPATAIFVSHCGWNSVLESAASSVPMVAWPLYAEQRMNAALLEGALGVALRSRAREDGGAVAREEVAAAVNELMEGENGLVVRRRAEDLQRAAARAWSPDGSSRRALEDVAAKWRAALGAGS

SEQ ID NO: 5239 - DNA, 1546 bp, Triticum aestivum
  misc_feature (1)..(1546): Ceres cDNA ID no. 22005660
  misc_feature (1)..(1546): Ceres CLONE  ID no. 906915
  misc_feature (1)..(1546): Also known as  Ceres CDNA ID no. 24411278
gtcggatccccccaccacacattgacactggaccgtggatccaatccccttccacccgccgcaccagctcgaaaatttccccatcggaaaccctcgccgcctccacccaccatgccgccgccggtgctgccggacgagctcctcgaggaggtcttcttccgcctcccgccggacgagcccgagcatctcctgtgcgcctccctcgtcagcaaggtctggctcggcctcctctctgcccctcgcttccgtgctcgctaccgcgacttccatggagctcccccaatgctaggtttcctgtgttcccttcgatcgaactccgtccatgaggcggaagacaacatcccacacttccttcccaccacgaaattccgcgcgcgcatacccgacgacgactgggggtgctggggctacactgcgtgggactgccgccatggccgcgttctcctcggcgaccagtcttaccaacccgtcccgctcgtcgtttgggaccccatgacgggctgccggagggagctggactcgcccgaccagttgcgcagaagctatggggcagcggtgttctgcgccgtggccggctgtgaccaccgtgcgtgccatgcaggccccttccaggtgctctacatcggtgtggacacgattgaagatggtgaatatgttgcgcgcgcgtgcttgtccttgccggtgaccggtgattggagcaagccatgctctggttctcgttttaataagtggaacgagccgtgctcagctcttcatcttggacccattgcattttgggacgaactgtcccctgtcttcgtccaagacgcactgcacttcaagctcgtgtattacctagataatcacatagcaattcttaagtatgacttgggatctaactgcttatcattgattgatgcgccgttggcggggtctatccttctcaatgcctctatcctcgtggcgatggaggatggcagattggggtttgcgaatgtggacatgttgaccatccacttgtggtcaagacaaaggggttccgatggaattgcgtcatggactcagcgtacagtcatcaatattaataaccttctccccattcataatcccaataagattcttagactgattgggtctgtggagggcagagatatcattttcgtggccattggccttgacatctacgggattaatctcaagacattacggtggaagaagctacagaagagaaaaaagctttgtggtttgattctgtacatgagtttctacaatccacaagaaagagtgatccccggtgatgcggcgcattgacaatgtatggttgagtatgcttagggtagcagggccactctcataaacaagaaatcggagggagtatgtagttggttttgccagtggtgcttgtttttcatgctgttgttggcttttgccacaaagcttataatttccccgccagtagctatgtgtaagtggatgaatgggttatcttgttatgaacctccaatttcttgcagcatcagttatgtgctcttttgtcagtagctatgtactaaaaaaaaaaaaaaaa

SEQ ID NO: 5240 - protein, 392 aa, Triticum aestivum
  misc_feature: PFam Name: F-box; PFam Description: F-box domain
  misc_feature: GI Number: 34914028; NR Description: OJ1014_G12.29 [Oryza sativa (japonica cultivar-group)] >gi|20146312|dbj|BAB89094.1| OJ1014_G12.29 [Oryza sativa (japonica cultivar-group)] >gi|21328077|dbj|BAC00661.1| B1144D11.8 [Oryza sativa (japonica
MPPPVLPDELLEEVFFRLPPDEPEHLLCASLVSKVWLGLLSAPRFRARYRDFHGAPPMLGFLCSLRSNSVHEAEDNIPHFLPTTKFRARIPDDDWGCWGYTAWDCRHGRVLLGDQSYQPVPLVVWDPMTGCRRELDSPDQLRRSYGAAVFCAVAGCDHRACHAGPFQVLYIGVDTIEDGEYVARACLSLPVTGDWSKPCSGSRFNKWNEPCSALHLGPIAFWDELSPVFVQDALHFKLVYYLDNHIAILKYDLGSNCLSLIDAPLAGSILLNASILVAMEDGRLGFANVDMLTIHLWSRQRGSDGIASWTQRTVININNLLPIHNPNKILRLIGSVEGRDIIFVAIGLDIYGINLKTLRWKKLQKRKKLCGLILYMSFYNPQERVIPGDAAH

SEQ ID NO: 5241 - DNA, 1417 bp, Triticum aestivum
  misc_feature (1)..(1417): Ceres cDNA ID no. 22005661
  misc_feature (1)..(1417): Ceres CLONE  ID no. 907049
  misc_feature (1)..(1417): Also known as  Ceres CDNA ID no. 24409480
actttacacttccctcctcgtcaggtacccatccatccatcgaccctcgggcttgttcgggagcagagaccgagctcttgatcttgagggaggaagacagccatggctcgttttcttaggccgtccaactgcattgcctaccttctcctcctccttgccttctgctgctgcggaacagaacagcggagagtggaagcatccaaccgactcacccaacacccaaggatcctgaccaccgtctcggtgatgaaaccatcgtaccccacgatcaccacgcccacttccgcatcctacgctatgccggcgtcctccaggttcccgtcgctggcggatgcgaacgacggcggtgacgtcggcggaggtggcattggcggtggcggtgctgctggtggtgccaccggcggtggtggtactactggcggtggcgtgggcggcggcggtgctacgggcgggggagctgtcggtggcgtgggcggcggcggtgctgctggaggcatcggcggtggcggtggcggtgggggtggcgggacgtggtgcgtggcgagccagagcgcgagcacgtccgcgctgcaggtggcgctggactatgcgtgcggctacagcggcgtagactgctcggccatccagacaggtgggagctgcttcaacccggataccatccacgaccatgcgtcctacgccttcaacagctactaccagaagaaccctctccccaccagctgcgactttggcggcacggccaccatcaccaccaccaatcccagttcagggtcgtgccagtatccagcgtcaagcggcggcgctcaagggaccatgcccccgccatcaccgaccactctgacgccgaccacgccgatgactccgacgccgatgaccccattcaccccgacgccaatgacgccggacacccctagcaccgggacgcctatgtacggatcaaactcgccaccggacttcgggtcgatgtcccctccaggcccaggatcaaactcacctccggactacagcgacgtcggcggcgccccggcgacggcgatgggcagggcaacgctggctctcgtctccatccttgccgcgacgctatcgatgagcctcgccacatgaggcgatacacgcgtctcgagatggcaatcctatgcagcagtcaaagaagcgcgcgccgttggatgctgggatgcgcacgcacggttgcaccgcagaacagaaacctccctgccgcgaaaccttgcacaaagcagaggtgccccatttgtttagtagtatcttcacaactctgaagcatgcatgctgatgcagctgcttctagcgtcgccactgctctgctctagtggggggcagcagatgtttatatatccgattatactattgtatttagaaatttatgagcaatttcatttcctcaaaaaaaaaaaaaaaa

SEQ ID NO: 5242 - protein, 333 aa, Triticum aestivum
  misc_feature: PFam Name: X8; PFam Description: X8 domain
  misc_feature: PFam Name: NmrA; PFam Description: NmrA-like family
  misc_feature: PFam Name: GRP; PFam Description: Glycine rich protein family
  misc_feature: PFam Name: Bindin; PFam Description: Bindin
  misc_feature: PFam Name: Secretin_N; PFam Description: Bacterial type
  misc_feature: GI Number: 34912962; NR Description: beta-1,3 glucanase-like protein [Oryza sativa (japonica cultivar-group)] >gi|20161490|dbj|BAB90413.1| beta-1,3 glucanase-like protein [Oryza
  misc_feature: GI Number: 22329437; NR Description: glucan
  misc_feature: GI Number: 53793113; NR Description: elicitor inducible
  misc_feature: GI Number: 11071974; NR Description: elicitor inducible
  misc_feature: GI Number: 50939031; NR Description: glycosyl hydrolase family 17-like protein [Oryza sativa (japonica cultivar-group)] >gi|22775658|dbj|BAC15512.1| glycosyl hydrolase family 17-like protein [Oryza sativa (japonica cultivar-group)]
MARFLRPSNCIAYLLLLLAFCCCGTEQRRVEASNRLTQHPRILTTVSVMKPSYPTITTPTSASYAMPASSRFPSLADANDGGDVGGGGIGGGGAAGGATGGGGTTGGGVGGGGATGGGAVGGVGGGGAAGGIGGGGGGGGGGTWCVASQSASTSALQVALDYACGYSGVDCSAIQTGGSCFNPDTIHDHASYAFNSYYQKNPLPTSCDFGGTATITTTNPSSGSCQYPASSGGAQGTMPPPSPTTLTPTTPMTPTPMTPFTPTPMTPDTPSTGTPMYGSNSPPDFGSMSPPGPGSNSPPDYSDVGGAPATAMGRATLALVSILAATLSMSLAT

SEQ ID NO: 5243 - DNA, 1070 bp, Triticum aestivum
  misc_feature (1)..(1070): Ceres cDNA ID no. 22005662
  misc_feature (1)..(1070): Ceres CLONE  ID no. 908590
  misc_feature (1)..(1070): Also known as  Ceres CDNA ID no. 24410752
catgcattctccatctagtaggaagtactgcttccacagatttttttttacccagcatattttttatcagtaatgcttttcaaggatatttagatgttggctacttgagtttagattgtcatcaacaaaagtatgttagattttgaagccaaccaaagctactcctggcctgactattattggcggacctcagtcatgtttcaagtgcatttgataagtgaccgccaataagtaccaagtattttggcgctggctaaacccaatagtttgcaactttattcaagtctatttcctggatatttgtttgttggcctgaacattgttttatctccacacttctagatcggacttcctggggacaaagttcgtcatgtacgacaaccagaaaccatacgacggccccaagtccttgaagagccgatcaagtcgccgttttgcaaccaaacaaatcagcccacacgtttcaggcgacaatcttgaagttggacaggtgtcatacaggttcaacttcctcaaatcaagagggccaagaagaatgcactgcagtatccagtgccccgtaggccagggcaccgcatccgatccatccaaggagaagccaccgagcacctccagctccttgtctctaaaaaacaaagcgcctcgatggcacgaccacctgcagtgctggtgcttgaatttccacggcagggtgaccgtcgcctccgtgaagaacttccagctcgtcgccccggccgacaccagcgatccatggggcgtcggggacgaggagacggtgatcctccagttcggtaagatcgaggacgacgcgttcacgatggacttccggcatcccctgtcggcctaccaggcgttcgccatctgcctcaccagctttggcacgaagctggcctgtgaataagtgccatctctgttgatgttaccgtgtgaatcatgtggcggatggcatgaactcttgctctgttaatccgggagaaaggggtggcgctgtgatactgtactcgcaatctctgctcttctctttctcgtctgatgatggatgtggatttgactcaaaaaaaaaaaaaaaa

SEQ ID NO: 5244 - protein, 176 aa, Triticum aestivum
  misc_feature: PFam Name: Tub; PFam Description: Tub family
  misc_feature: GI Number: 51451349; NR Description: putative tubby protein
  misc_feature: GI Number: 34911070; NR Description: putative tubby-like protein [Oryza sativa (japonica cultivar-group)] >gi|21104731|dbj|BAB93319.1| putative tubby-like protein [Oryza sativa (japonica cultivar-group)] >gi|21644629|dbj|BAC01188.1|
  misc_feature: GI Number: 7769867; NR Description: F12M16.22 [Arabidopsis
  misc_feature: GI Number: 51854261; NR Description: putative tubby protein
  misc_feature: GI Number: 34909710; NR Description: putative Tub family protein [Oryza sativa (japonica cultivar-group)] >gi|14587286|dbj|BAB61197.1| putative Tub family protein [Oryza sativa (japonica cultivar-group)] >gi|20161308|dbj|BAB90233.1|
MYDNQKPYDGPKSLKSRSSRRFATKQISPHVSGDNLEVGQVSYRFNFLKSRGPRRMHCSIQCPVGQGTASDPSKEKPPSTSSSLSLKNKAPRWHDHLQCWCLNFHGRVTVASVKNFQLVAPADTSDPWGVGDEETVILQFGKIEDDAFTMDFRHPLSAYQAFAICLTSFGTKLACE

SEQ ID NO: 5245 - DNA, 1764 bp, Triticum aestivum
  misc_feature (1)..(1764): Ceres cDNA ID no. 22005663
  misc_feature (1)..(1764): Ceres CLONE  ID no. 908851
  misc_feature (1)..(1764): Also known as  Ceres CDNA ID no. 24412307
atattgttcttcttccatttttgttaactgaatctgttgttttgttttctttttttgagattcaatctcttattatgtgattatatgtgatgtgttacctctcctctctgcgcgcgactctgccatggccgcttgcagatcatctacatgcatggtttcgccaggctccacggcaagaagtcccagatcatggaccacatggtggggcaggtcgacctgcagccgccgcgccgctcaacgctgcacggtagcgccgcgctcgcgccgccctccgccgcgcggatcgccgccgcacaggcctcggccgacgtcgacgccatcggctgggcggagtgccccatcggctgcgtcaccgccttctccgccttcgctgacccgccggacccggtggagcccatgcccccgcccgcccaccacatgctcgcgctggcgatgcccctgcgccgcccacgctccaagaggacgcgcacctccccttaccagctccctgccgcgtccaacacggccaaggtgaaggaggaggcggtcatggaagaggagggtgaggatatgtcgttggcgacgccgtcgccgccgcgatggatgcgctcccctaccccgccacctccgccgccgtcgcccacgccgcggccacagaccgtggtgcctccgccactatggatgcgctcccctactccgccacctccgcccccgtcgccctctccgcggccgcagaccgtggtgcctccgccttcgccgccgtgcaggggccagcctgagttggagccgaccctctctcgtccaccaggcttcggctcgccgccggaaccatgcaggagccggcctacgctggagcggatcctccccacaccaccaccaccaggcttcggcccgccgccggaaccatgcaggagcgggcctacgctggagccgatcctcccaacaccaccaccaccaggcttcggcccgccgccggaaccatgcaggagcgggcctacgctggagccgatcctcccaacaccaccaccaccaggcttcggcccgccgccgcaaccatgctggagccggcctacgttggcgccgcctcctaccccaccaccaggcttcggttcgcgccaggtggcgccgcctcctccgcacctgtcctggggcttgccgttgcgaccgccgtcgggcccaggagcgcctacgttcacgcagcatcttcagcctgcaggtccggcaccactctggcgctcgccgatgtcgccgtcttatccggcaccgtgcttgggcgcgccttctgggccgccgccggcgcaagcgccttggcgctggccacatccaccgccgcgctgggcaccacctcatatgctgcgcccgccgccgccaccctgggactgcatgaggccgtttgcacctcctatgccgccgcaacacccgccgcattttgagatgcagcatacgccaccggcaccgggggcgtgctcgggcaggcaggtgatttacttctagggactgctctcgtatcgcatttgctgttattgctaagcttgacagtttttgttttgacggtagctaagcttgagagttactactacacggtgacgggaaaattagggacaaggttatcaatttactgttggagctgcgaactgtttttgctctgctccaccttgctgctgctagtcttgccatgccattattgtgcccagaaccatgatcagtggggatattggaatgattcatgcatgtctcatgtttacttatgtacagtactttctttccgcaaaaaaaaaaaaaaaa

SEQ ID NO: 5246 - protein, 441 aa, Triticum aestivum
  misc_feature: PFam Name: Pyr_redox_2; PFam Description: Pyridine
  misc_feature: PFam Name: GATase_2; PFam Description: Glutamine
  misc_feature: PFam Name: LMBR1; PFam Description: LMBR1-like membrane protein
  misc_feature: PFam Name: Extensin_2; PFam Description: Extensin-like region
  misc_feature: PFam Name: FH2; PFam Description: Formin Homology 2 Domain
  misc_feature: GI Number: 6523547; NR Description: hydroxyproline-rich
  misc_feature: GI Number: 15145797; NR Description: basic proline-rich
  misc_feature: GI Number: 15145793; NR Description: basic proline-rich
  misc_feature: GI Number: 60678627; NR Description: plus agglutinin
  misc_feature: GI Number: 41400384; NR Description: plus agglutinin
MHGFARLHGKKSQIMDHMVGQVDLQPPRRSTLHGSAALAPPSAARIAAAQASADVDAIGWAECPIGCVTAFSAFADPPDPVEPMPPPAHHMLALAMPLRRPRSKRTRTSPYQLPAASNTAKVKEEAVMEEEGEDMSLATPSPPRWMRSPTPPPPPPSPTPRPQTVVPPPLWMRSPTPPPPPPSPSPRPQTVVPPPSPPCRGQPELEPTLSRPPGFGSPPEPCRSRPTLERILPTPPPPGFGPPPEPCRSGPTLEPILPTPPPPGFGPPPEPCRSGPTLEPILPTPPPPGFGPPPQPCWSRPTLAPPPTPPPGFGSRQVAPPPPHLSWGLPLRPPSGPGAPTFTQHLQPAGPAPLWRSPMSPSYPAPCLGAPSGPPPAQAPWRWPHPPPRWAPPHMLRPPPPPWDCMRPFAPPMPPQHPPHFEMQHTPPAPGACSGRQVIYF

SEQ ID NO: 5247 - DNA, 1727 bp, Triticum aestivum
  misc_feature (1)..(1727): Ceres cDNA ID no. 22005664
  misc_feature (1)..(1727): Ceres CLONE  ID no. 912971
  misc_feature (1)..(1727): Also known as  Ceres CDNA ID no. 24411292
ttctggccttcaatcctacgtccaactgcgcaacgtctgctggccgtgtgcaacgcggcatcgatgacccaccaacaacttgaacttccactccagaaagggtagcaaaagccctgtcaggtgaaacaaaccaaaaacccgatgtccgcgaccacggccgaggccgtgcgccggctctgcgccgccggcgagctgcggtcggcgctggcgcagctcgcccgcggcgccaaggcgggcgacggggcgctggacgtggccgcgtgcacggcgctcgtccacgcctgctgcaggaccggcgacctggcggaggcgcggagggtgttcggcgcaatgccgcgcctggggctggccccgaacgaggtcaccttcaccgccctgatccacggccacttcgtccgcgggcgcagggaggagggcttcgccttcttcgaggagatgaggaggggcggggtcgagccgaacatctacacctacaacgtcctgatcggggagtggtgcaggacgggggagttcgagggcgcccgccgcctgttcgacgaaatgcccgccaagggcgtcgcgcggaacgccgtcagctacaacaccctgatcgcggggttgtgcaggcacggcaagatgaaggacgccgcccggctgctggagacgatgcggaaggagggcatccgcccgagcatcgtgacattcaacctccttgtcgatggttacggcaaggctgggcagatgtccaatgccttgcatttctccaaccaaataagggcggcggggcaccagcccaacgctctgacgtacaatgcgctcattgcggggttctgccgtgctagagatattgcccgtgcaaacagggcgttctctgacatgaaggagcgaggactggcacccacaaatgggacctacactatactgattgatgcattggcccggggcggtgacatggacaaagcttttgagatgtttgcggacatggggaaggctggtttggaggtggatgtgcgcacttacggtgttttggtgcatgctctctgcatggaagggaaaatgaaggatgccaggaagctgttccagtcgatggaggagaaaggtgttaaggcgaacagtgtgatctatgacattatgatttttggctatggacgagaagggaactcctacaaggctatgaaattaatcacggagatgaggaagaatggcttggttccaaatttcgctagctatggcctgacgatccgtagtctttgtaatgatggtaaatgcccggaagctgaagctcttatcaaggacatggtgcgggctggtctacaaccaaacgaatcggtctcccaagcactactgaatgccaaggcaagacagggaagctcgaccagtaacttttttacctaggcagtcaagcatgtgttttttgtttctgtgcaaattcagatgttgtatgtttgtcttgagaaagtgggaagaggaagcacaccctctggtggaaatctgatgaaatttctttagtaaactgaaacaccgctcagtgatttactggacattgccaaaacttaaccaagggcggtacgatagtgataagcaaattcaaagcaacaaaaggtagatgtatgtgcagcgagataaaggtcagtgcatccgtacttgtataatttatgttggctgtgtaggtacatttgtgttgtatgtatagcagcgaccaagttatatgcaagttggataattcggtttgaaaaaaaaaaaaaaaa

SEQ ID NO: 5248 - protein, 410 aa, Triticum aestivum
  misc_feature: PFam Name: PPR; PFam Description: PPR repeat
  misc_feature: GI Number: 8493580; NR Description: Contains weak similarity to leaf protein from Ipomea nil gb|D85101 and contains a RepB PF|01051 protein and multiple PPR PF|01535 repeats. [Arabidopsis
  misc_feature: GI Number: 15221635; NR Description: pentatricopeptide (PPR)
  misc_feature: GI Number: 24111307; NR Description: At1g12620/T12C24_25 [Arabidopsis thaliana] >gi|13605505|gb|AAK32746.1| At1g12620/T12C24_25 [Arabidopsis thaliana] >gi|18391414|ref|NP_563911.1| pentatricopeptide (PPR)
  misc_feature: GI Number: 6630464; NR Description: F23N19.4 [Arabidopsis thaliana]
  misc_feature: GI Number: 9502388; NR Description: T12C24.15 [Arabidopsis
MSATTAEAVRRLCAAGELRSALAQLARGAKAGDGALDVAACTALVHACCRTGDLAEARRVFGAMPRLGLAPNEVTFTALIHGHFVRGRREEGFAFFEEMRRGGVEPNIYTYNVLIGEWCRTGEFEGARRLFDEMPAKGVARNAVSYNTLIAGLCRHGKMKDAARLLETMRKEGIRPSIVTFNLLVDGYGKAGQMSNALHFSNQIRAAGHQPNALTYNALIAGFCRARDIARANRAFSDMKERGLAPTNGTYTILIDALARGGDMDKAFEMFADMGKAGLEVDVRTYGVLVHALCMEGKMKDARKLFQSMEEKGVKANSVIYDIMIFGYGREGNSYKAMKLITEMRKNGLVPNFASYGLTIRSLCNDGKCPEAEALIKDMVRAGLQPNESVSQALLNAKARQGSSTSNFFT

SEQ ID NO: 5249 - DNA, 1563 bp, Triticum aestivum
  misc_feature (1)..(1563): Ceres cDNA ID no. 22005667
  misc_feature (1)..(1563): Ceres CLONE  ID no. 919540
  misc_feature (1)..(1563): Also known as  Ceres CDNA ID no. 24727222
atttttctcggttcttggcaccttcctgtcttttctagatttcattggatcccatatagggcctccaccacattcatttgccttgatagccgccagctgctcctcttcctcccttctccagatttcttggctccctgggctccctggcttgcccagagattgcaacgaaatcttgcagggctcttctttggtttcttgttcatgctgggagccatggatgagaggatcccgccgccccctttcttccagtactcgccgtccggcgtccattcttcccctcaccaccacaaccccatgaggtcgtctgcctccgagagggagaggtatattgctgagttacttgctgagaggcagaaactagttcccttcctgcaagttcttccattttgtaacaggcttttaaaccaagaaattctgcgggcatcttctttgccacctaacccaaattttgttgaacctgagagattcgattatggtagcccattaagattagctggccaccctatgaacggtcaaccaatggatatggagggatggactggaatgcatgcagagcatatggggatacaccattcaccatccatgggctggaatggtggtcctggagttgtgggcggccctgttgtgaagaaacttgtcaggatggatgttccagcagaaaagtatccaaatttcaactttgttggccgtttgttggggccacaaggaaactccctgaaaagagttgaagctacaacacaatgtagagtctatattcgtggacgtggttcagtgaaagatactgtgaaggaaaacaagcttagagctaagcctggctatgagcacttaaacgaaccactgcatgtgcttatcgaagctgagttcccggcggatatcgttgatgcgcgactaaaccaggctgtggtcatactggaagatcttctcaaaccagtagatgaatccatggattacttcaagaagcaacagctgagagaattggcaatactgaatggcactctaagggaggaggaaagcccaagcccaagcccccatctcagtcccagtgtatcaccgttcaactccaccgggatgaaacgcgcgaaaacgggccggtgatcgtgcttctgaatactgatttgcctgaggtgactatgatttgaacagatcgcgcgcaaacctgttctactgctggaaatgattcatgatgcatatgggggaccggccttgaggctcgtcgcatctgtgatacgagctgagatacatctttggatgaatggtcgctatggaagaaattcgtttcgttcggtctgctcgaggaatcggggcttgctgtttggtcttattgattattctctgtgtatctatctgactcccaaatattaactttatcggtttggattagttaaccgtgattgatctgtggctcaagtaaaatagttgtggacaataatccgggtttttgtcagttgtaacatgtccgaggggggttgatgttcttgtgaacagacattgttggtccaaagttatgaaccgcaagcaacgtcatgaagatgactcgcttgcctcccaaaaaaaaaaaaaaaa

SEQ ID NO: 5250 - protein, 297 aa, Triticum aestivum
  misc_feature: PFam Name: KH_1; PFam Description: KH domain
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 50902256; NR Description: P0408G07.16 [Oryza sativa (japonica cultivar-group)] >gi|20161243|dbj|BAB90170.1| P0408G07.16 [Oryza sativa (japonica cultivar-group)] >gi|21328045|dbj|BAC00630.1| P0434C04.5 [Oryza sativa (japonica
  misc_feature: GI Number: 26452384; NR Description: putative elongation factor [Arabidopsis thaliana] >gi|51971995|dbj|BAD44662.1| putative elongation factor [Arabidopsis thaliana] >gi|51971727|dbj|BAD44528.1| putative elongation factor
  misc_feature: GI Number: 19310523; NR Description: At1g09660/F21M12_5 [Arabidopsis thaliana] >gi|16930473|gb|AAL31922.1|
  misc_feature: GI Number: 24030184; NR Description: putative RNA-binding protein [Arabidopsis thaliana] >gi|9758634|dbj|BAB09296.1| RNA-binding protein-like [Arabidopsis thaliana] >gi|15241136|ref|NP_200425.1| KH domain-containing protein
MLGAMDERIPPPPFFQYSPSGVHSSPHHHNPMRSSASERERYIAELLAERQKLVPFLQVLPFCNRLLNQEILRASSLPPNPNFVEPERFDYGSPLRLAGHPMNGQPMDMEGWTGMHAEHMGIHHSPSMGWNGGPGVVGGPVVKKLVRMDVPAEKYPNFNFVGRLLGPQGNSLKRVEATTQCRVYIRGRGSVKDTVKENKLRAKPGYEHLNEPLHVLIEAEFPADIVDARLNQAVVILEDLLKPVDESMDYFKKQQLRELAILNGTLREEESPSPSPHLSPSVSPFNSTGMKRAKTGR

SEQ ID NO: 5251 - DNA, 1315 bp, Triticum aestivum
  misc_feature (1)..(1315): Ceres cDNA ID no. 22005669
  misc_feature (1)..(1315): Ceres CLONE  ID no. 923716
  misc_feature (1)..(1315): Also known as  Ceres CDNA ID no. 24411949
ctcttctccgagcagcgccatccctccctctgtccatcccgaccgctgcctccatcgaggaggtaggagtctaggagatcagcgagctgctaggccgacagcttgcggcgggccatcacagaagctacgccgtacgcggcggcggctagccccagcttaatagattagttctgccatggcgaggcttcccggtctgcgttgctgtgaccttgccgcgcgcggctccctccctcctctcggccttgcctgccgccctcgcaggtcgccccgcgcctcggctctacgctactcgtctctccaagctggtgacagtctcgggaaggatgtcttgcgcatgttccttgaggataggcagacgaatggggacctggtctccaaagtcgctgacatggttttgaggagaaacgacacaggtcttgatgtgttagaggctaccacagatcaagaaaatgctgcagatgttgggcaacctgaagatttcagggatgatgttatgagtgagggagtcgtgggatttgaggcaattggagattttgtgtccgctgagggcagccttactgcgagaaggaggctttctgctctggctgggcagaaagagagtgataaaaggaaggaattcaaccttctgagatatgaagcaattaaggacgaactgttgctcttgaccataggaattggagccgcttgcactatatattgtgtcctagtcttctctgtggaggctggtatcagttatgcttttggagttgctttcagctggttgtatcttcaacttctgtatcgacacgcagataacctgtcaaaggaagatgttcctgaagtttttctaaagaagaaagtgaagaaaatcggcattcgaagcgaggatttgaaggatacaatagagaagacattgggtggctctctatttgttctttcatccccaaggcttataattcctgcagtgatttttgggttgtcaactttttctagtcattttcaaaatagcatttttaactttgagcttgttccagggatgatggggttctttgcgtacaaggccgcagctttggtacaagtctacagagataacgatgatcttagattgatactccccgaggacgatcctgactacacctgaaaagttttgaggatgagagttttttcacctagttttcctttataaagcaaagggcacattgatgtatagtttatgttatagtttgaaataaatcccgctgatcttttgtgtgcatgataaaaaataatgcaatgacagaagggatggtaaagagctggaaagactggaatattaccgctaaaaaaaaaaaaaaaa

SEQ ID NO: 5252 - protein, 314 aa, Triticum aestivum
MARLPGLRCCDLAARGSLPPLGLACRPRRSPRASALRYSSLQAGDSLGKDVLRMFLEDRQTNGDLVSKVADMVLRRNDTGLDVLEATTDQENAADVGQPEDFRDDVMSEGVVGFEAIGDFVSAEGSLTARRRLSALAGQKESDKRKEFNLLRYEAIKDELLLLTIGIGAACTIYCVLVFSVEAGISYAFGVAFSWLYLQLLYRHADNLSKEDVPEVFLKKKVKKIGIRSEDLKDTIEKTLGGSLFVLSSPRLIIPAVIFGLSTFSSHFQNSIFNFELVPGMMGFFAYKAAALVQVYRDNDDLRLILPEDDPDYT

SEQ ID NO: 5253 - DNA, 1901 bp, Triticum aestivum
  misc_feature (1)..(1901): Ceres cDNA ID no. 22005671
  misc_feature (1)..(1901): Ceres CLONE  ID no. 924983
  misc_feature (1)..(1901): Also known as  Ceres CDNA ID no. 24411096
gacacgcctcctcctcccctccgaaccgacccaaacccagcaaccctacgcagcgagcagcggcaatggggggcgccgccgacctggtgctgaaggcggcgtgcgacgcctgcggcaaggcgtccgagctctacagcaccgcctgccgccacgccaccccctgcaactcctgcgccgccaccatggcgcgctcgcgcgcgcgctgcaacgtctgcgccgcccccatcaccaacgtcatccgggagtacaatgttcgggtcgataccaccgcggggaaggccctttccatagccaaattcaacaccggcgtgccgcccttctccaagatgaagggtgcggggaacaagtggtctcttcgtaaggatggcctgacgcaaggccggcagcttactgccgatatgcgggagaagtactacaacagaaagccatggatattggaagatgacacaggtgaacatcagtaccaaagtcaacttgaggcatcacaatctgcaactgctacatactatctgctgattaggcgtggcaaggagttcgatgctgttcctgttggttcatggtataacttcagtaaaattgcacagtacaaacaactgactttggaagaagctgaagagaagatgaataaaaggagaagcagtgcaactgggtatgaacgatggatgatgaagacagctacacatggagccgccgcctttggttcggatctgaaggatcttggtgatgcaaagggcaaggcggcagatggggtccaatccaagaaagaaagtagcaatgaggatgggaatcactctgataaaggcgaggaggacgaagaagagggagttgcaaagaaagctgtgcgtgggctttctacgaggggtgtggatgatgaagaggatggcggaaaagaagactttgatttggaggatgagattgagataggtgatgattgggagcatgaagagaccttcactgatgatgatgaggctctggatattgacccagaggaaagacctgatgtagctgatactgaaaaccctactggaccagatattaagcaggatgatgatgagaatgagcaaggagctggtggtaacctgagcaagtccggtaaggaactaaaaaagctgctccgccgtgctgatggacaaaatgagtccgatgacgaagacgatggagacactgatgaagacgagtcaccattgtcagtacttgctccaaaactggaacatcaattcggaagtgagcaacaggaaaataacactgctaaactaacagcaacagaacttgctgttagcactccacctgcacccaggtccaatcaaaaaaggaaatccggaggtgatggtgcaaaaacttcgaatcgtgcagcggtaaaaaagccgaaggcagaacctgaggcaaaaacattaggtgtcaagaaggagccaccctcttccgtggaacctatttcaaaagcatctgcttcagcagggagtgacacagatacatctgcaattacagaggaggaaatcataagagtacttcgtgcaattgctcctgtcagatcacaagattttgtacccaggtttaaggccagaataagaactccagaggacaagaaacattttcatgacattgtgatgaaatatgcgtactcgcacaagaccaacggcgtcagctatcttcaccttcgaaaggagtacgaatgaacaaacagttaacacatttgtatatgccattatacccttctagcattgcatgccatacttagcaaaaactgctgaatacgtccttgtaactggccgcccattcttgtctctattcttttgtttcagcttgtaatgacaaggattctggctggttgacttggtattcaaaattgaattttgaccattgatatcttttacgacgtatgattactaaaaaaaaaaaaaaaa

SEQ ID NO: 5254 - protein, 535 aa, Triticum aestivum
  misc_feature: PFam Name: TFIIF_alpha; PFam Description: Transcription
  misc_feature: PFam Name: Chromadorea_ALT; PFam Description: Chromadorea
  misc_feature: PFam Name: Extensin_2; PFam Description: Extensin-like region
  misc_feature: GI Number: 62733661; NR Description: putative transcription
  misc_feature: GI Number: 62733662; NR Description: putative transcription
  misc_feature: GI Number: 39545900; NR Description: mutant TFIIF-alpha
  misc_feature: GI Number: 42566724; NR Description: transcription initiation factor IIF alpha subunit (TFIIF-alpha) family protein [Arabidopsis
  misc_feature: GI Number: 65030; NR Description: transcription factor IIF subunit [Xenopus laevis] >gi|47682820|gb|AAH70569.1| LOC398325 protein [Xenopus laevis] >gi|464522|sp|Q04870|T2FA_XENLA Transcription initiation factor IIF, alpha subunit (TFIIF-alpha)
MGGAADLVLKAACDACGKASELYSTACRHATPCNSCAATMARSRARCNVCAAPITNVIREYNVRVDTTAGKALSIAKFNTGVPPFSKMKGAGNKWSLRKDGLTQGRQLTADMREKYYNRKPWILEDDTGEHQYQSQLEASQSATATYYLLIRRGKEFDAVPVGSWYNFSKIAQYKQLTLEEAEEKMNKRRSSATGYERWMMKTATHGAAAFGSDLKDLGDAKGKAADGVQSKKESSNEDGNHSDKGEEDEEEGVAKKAVRGLSTRGVDDEEDGGKEDFDLEDEIEIGDDWEHEETFTDDDEALDIDPEERPDVADTENPTGPDIKQDDDENEQGAGGNLSKSGKELKKLLRRADGQNESDDEDDGDTDEDESPLSVLAPKLEHQFGSEQQENNTAKLTATELAVSTPPAPRSNQKRKSGGDGAKTSNRAAVKKPKAEPEAKTLGVKKEPPSSVEPISKASASAGSDTDTSAITEEEIIRVLRAIAPVRSQDFVPRFKARIRTPEDKKHFHDIVMKYAYSHKTNGVSYLHLRKEYE

SEQ ID NO: 5255 - DNA, 1822 bp, Triticum aestivum
  misc_feature (1)..(1822): Ceres cDNA ID no. 22005672
  misc_feature (1)..(1822): Ceres CLONE  ID no. 927057
  misc_feature (1)..(1822): Also known as  Ceres CDNA ID no. 24410774
ctgcatgcctcaacgaaccatctccaagaaaacacctcaccccaatccaaccccaaaccaatcctctccacaaaccaatctaacacaattcccccacttattttctcatcgagattcgatcagagcagttggcgatgaagcttgacagggagatggagatgctcctcaacgagatccctctcctcctccacggcgacgtcctcggctgcggcgagccagccgccgcggagaccgacaccgatgccgtcgatttctcttacctcatccaagaactcggcgagatggggttcgtcgaggacgacgacgatgacgacgacaacgctttccttcaccccaggaaggccagctcatccccgacgagcaacctccatttcatggacgccgagaatttcgtggcgtcgcgtcccttctccatggacaaagaccgcgagagggctctgttcgatccgttccccttctccagcacctgcttcgacgccgccgtgggcgacgactgggacctcctgtgtccgccggcgaggtcccggctgtgcaagacggcgaggccgaagaagggtacctgcagccatggcaacggctgccaggcgacgagccccaagaagtgcgcggcggcgaagccgtccaagtacgagagccttgtcgggctgcgcgggtacatgtaccacgtggccagggaccagcacggctgccggtttctccagcagcggctcgacgacggcaagcgcgaggtcgatttcatcttcaccggcgtcgcccgtcacgccgtcgacctgatggtgaacccattcgggaactacctcatgcagaagctgctagccgtctgcagcgaggagcagaggatgggcatcgtgctcaccctcacaaaggaccccttcgtgctcgtcaggatctctctcaatgtacatgggacaagggccgtacagaaactgattgaaagcttgagggcaagggaggagatccagctggtcgtcgcagctctgcgccccgggttcctggagctcataaaggatcctaatggtaaccatgtcgtgcagaagtgcttgcaatcgttcggggccgatgataacaagcccatcttcgatgctgctgctgtttattgccttgatatcgggatgcaatgccatggctgctgcgtcctgcagcggtgtattgcgcgttcgacgggtgagcacaaggagaagctggttgccgcaatcgctcgcaatgggttcgaacttgcacaagatgcctatggaaactatgttgttcagtatgtgatagaactaaaggtcgctactgcaaatgcaagtctggcacagcagtttgaaggcaagtacatccacctctccatgcagaagttcagcagcaacgttgtcgagaaatgcctgaaagttttcaaggaagccgacaaagccaacatcatcctggagctcctttctgcgccgcagttcgagcggttgcttctgcacccttacgcaaactatgtggtctacgcagcacttcagaattccaaggggtctctccactcagcactgaccaacgccatccggcctcatgtggaactactcagaaccagcccatactgcaagaggatctactctcgagctttgctgaagaagtgatggcctgatgagaccatctcaccatgtaacaataaagattgtttgtcttgtgctattttttcggattcaaaagggataaaggtgatctcgccatgtagattttgtatagatcaaaattatttggtcatgtacttctatgtgcacctttattgggtgcactcttccgttgccataatccatctggaatggtaagttccggttgaacaaaaaaaaaaaaaaaa

SEQ ID NO: 5256 - protein, 488 aa, Triticum aestivum
  misc_feature: PFam Name: PUF; PFam Description: Pumilio-family RNA binding
  misc_feature: GI Number: 22330712; NR Description: pumilio/Puf RNA-binding
  misc_feature: GI Number: 25518106; NR Description: F16L1.3 protein - Arabidopsis thaliana >gi|9454526|gb|AAF87849.1| Contains similarity to RNA binding protein PufA from Dictyostelium discoideum gi|5106561 and contains multiple Pumilio-family RNA
  misc_feature: GI Number: 15219849; NR Description: pumilio/Puf RNA-binding
  misc_feature: GI Number: 22327888; NR Description: pumilio/Puf RNA-binding
  misc_feature: GI Number: 15220217; NR Description: pumilio/Puf RNA-binding
MKLDREMEMLLNEIPLLLHGDVLGCGEPAAAETDTDAVDFSYLIQELGEMGFVEDDDDDDDNAFLHPRKASSSPTSNLHFMDAENFVASRPFSMDKDRERALFDPFPFSSTCFDAAVGDDWDLLCPPARSRLCKTARPKKGTCSHGNGCQATSPKKCAAAKPSKYESLVGLRGYMYHVARDQHGCRFLQQRLDDGKREVDFIFTGVARHAVDLMVNPFGNYLMQKLLAVCSEEQRMGIVLTLTKDPFVLVRISLNVHGTRAVQKLIESLRAREEIQLVVAALRPGFLELIKDPNGNHVVQKCLQSFGADDNKPIFDAAAVYCLDIGMQCHGCCVLQRCIARSTGEHKEKLVAAIARNGFELAQDAYGNYVVQYVIELKVATANASLAQQFEGKYIHLSMQKFSSNVVEKCLKVFKEADKANIILELLSAPQFERLLLHPYANYVVYAALQNSKGSLHSALTNAIRPHVELLRTSPYCKRIYSRALLKK

SEQ ID NO: 5257 - DNA, 1391 bp, Triticum aestivum
  misc_feature (1)..(1391): Ceres cDNA ID no. 22005673
  misc_feature (1)..(1391): Ceres CLONE  ID no. 927860
  misc_feature (1)..(1391): Also known as  Ceres CDNA ID no. 24410488
acagacccacagacaaacttaccactggcaccgagtagcacttctctaccgtgccgccatctctctttctttctcacgattctcatcgactgaaaggcgaaccgtaataagcaccatggagttcgccggagaagccgacgacttcgctctcgacctcatccgcgagcacctgctcggcggcgacggtggtgtcctggcgacggctaaccatgagcagggccctttttgcgacgacgtcaccttccccgtgctgccaccttccgcggccgaaccgcaagcgtaccagcagcccatgttcttcccgcagcaggggcagcggcaggaacagacgcaaggttacatgggcctgacgcaccagtacgtgaactcatatccggctgccacggcggtgttccgtgcgccggagccggtgatgatacagttcggcggccagccgtctcctgtgagggcgctgtcgtccacgctgaccatctcggtgccgccccagggcacgttcggatgggcggggactgctgccgccgcagcgccagcgccagcaccggtcgaggacctccgcaagtaccgcggcgtccggcagcgaccgtggggcaagtacgcggcggagatccgcgacccaaagcgccggggctaccgcgagtggctcggcacctacgacacctccgtggaggccgcgcgtgcctacgaccgtgccgccttccggatgcgcggcgccaaggccattcttaactttccaaacgaggtcggcacccgcggcgccgagctgtgggcgcggccgcctgctggcccggcgtcccaggcagcaggcgcgacgaacaaacgtaagagatcacagggcgaggacgctgacgtcgaggtgaccggagtggtcataaacaaggccgtgagggccgaggcgccgtcgccgtcgtcggcccgggtgtcgtgggacacgccctcgtccttgtcgcgggggacagcgtcttcgacggtgacgtcggtggccacgacgccggagggagagtttcctccgacgccgtcaagctcgggctgggagcagtgctgggaggcgctgatgggaggcatgccgttgctgtcgcccctgtcgccacacccggcgttgggtttcccgcagcttagtgttagttaattaaaggatggttcattaagcgatagaatgtttccggtgtttgtaagaaaaacagagtaggcacccacacacagcacttgttgaacactagatttataattgaacaaagttattacatgcgtcttgctatccatgaaaatgttgtcaagctagtgtttgatctctattacatcagtgcaacaaccactgtaataactattcacccgttgttgttcatcggtttaaattggacagtcggcttttcttcacaaaaaaaaaaaaaaaa

SEQ ID NO: 5258 - protein, 336 aa, Triticum aestivum
  misc_feature: PFam Name: AP2; PFam Description: AP2 domain
  misc_feature: GI Number: 33440024; NR Description: Ap25 [Oryza sativa (japonica cultivar-group)] >gi|14140143|emb|CAC39060.1| putative
  misc_feature: GI Number: 50911403; NR Description: putative ethylene responsive element binding factor 5 [Oryza sativa (japonica cultivar-group)] >gi|49388202|dbj|BAD25325.1| putative ethylene responsive element binding factor 5 [Oryza sativa (japonica
  misc_feature: GI Number: 40060533; NR Description: putative ethylene
  misc_feature: GI Number: 18414895; NR Description: ethylene-responsive
  misc_feature: GI Number: 8809606; NR Description: ethylene responsive
MEFAGEADDFALDLIREHLLGGDGGVLATANHEQGPFCDDVTFPVLPPSAAEPQAYQQPMFFPQQGQRQEQTQGYMGLTHQYVNSYPAATAVFRAPEPVMIQFGGQPSPVRALSSTLTISVPPQGTFGWAGTAAAAAPAPAPVEDLRKYRGVRQRPWGKYAAEIRDPKRRGYREWLGTYDTSVEAARAYDRAAFRMRGAKAILNFPNEVGTRGAELWARPPAGPASQAAGATNKRKRSQGEDADVEVTGVVINKAVRAEAPSPSSARVSWDTPSSLSRGTASSTVTSVATTPEGEFPPTPSSSGWEQCWEALMGGMPLLSPLSPHPALGFPQLSVS

SEQ ID NO: 5259 - DNA, 1649 bp, Triticum aestivum
  misc_feature (1)..(1649): Ceres cDNA ID no. 22005674
  misc_feature (1)..(1649): Ceres CLONE  ID no. 929369
  misc_feature (1)..(1649): Also known as  Ceres CDNA ID no. 24408401
cttcatctcggagcaatcccccatccaattcgcccaaatccgcatcaggctgctctgagagagagagagagagagagagagagagagagagggatgggcagggcaagaaggggaacggcggccaagggcaagaggaggccgcgtactgcggcgaaggcggcagccgtggcgggcgacggacacgaggaaaccaaagatggacctgagaaagccgccggcggcgggggtggcttcttctgctgctacctcctccggtcgctctgcccgcgcagcaagagccgcacctacatcgggttcacggtgaacccgcggcggcggatccggcagcacaacggcgagctccgatgtggcgcctggcggaccaagcgcggccgcccctgggagatgatgctctgcatctacggcttccccaccaacgtcgccgccctccagttcgagtgggcgtggcagcaccctaccgagtcgctggccgttcgcaaggccgccgccgaattcaagtcgctcggcggcatcggcaacaaggtcaagctcgcctacaccatgctcaacctcccttcatgggagaacttgaatctcacggtgaacttcttctccaccaagaataccaagttcaccgcgggctgcccgcccctcccctgccacatgaagactgtcgttagcccgatggaggatctcccgtgctacgtcgagggcctttcgtccgaggatgatattatggagcctagagaggatgaagaagaacgagatgcggctgttggcggtgacacttctgatcatggtttgcagacaatggatttgggaacccgaattgtaggtggtgaatcagacactgatgagttttttgctccaatggatcggagtgaggtctttgcatcaagaatttcagaatcctctgcagcccggccagaggaagaagaaaccagaagtgctgactgtgatgttgaatataccattgatgacttcggtgaatcagacactgatgagttttttgctccgatggaagggagtgaggtctgtggatcaagaatttcagaatcctctggggcccaaccagtggaagaagaaaccagaattgctgactctgatgttgaatattatcccactgatgacttcagttacatggaatggggcggaattcacgagacatcggaattgcacgtgtctagaacaccacctcgatgttcctcgagctcgtgcagcgatgatgttgccggaagatcagtaaactgtgtgacaggggaagcatctccagtgttgaaggcaggttcagacgatggtaatcttttcttccatgaaattgatgtggtagacttggttacaccagtcgcccggtatgctagagattgcagcaaagtggccagcatttgccccaagattattgatctgacaaattcccctattgtcattgagttgtaatgctttgctggactgatccagtaccaaatcttgttgtagtaaaatgttatcatagaataacagcccagagatgagacaggtgtatacaatagacggatttgtacaagactgagtgttgagactcgcagtactcttttcttgagacagaattgttcacacaaaaaaaagtattcttgtcgtttcatcagaaataatgtattggggttctactaataagaaaaaaaaaaaaaaaa

SEQ ID NO: 5260 - protein, 440 aa, Triticum aestivum
  misc_feature: PFam Name: GIY-YIG; PFam Description: GIY-YIG catalytic domain
  misc_feature: GI Number: 33416746; NR Description: 2410170E21Rik protein
  misc_feature: GI Number: 34859212; NR Description: similar to RIKEN cDNA
  misc_feature: GI Number: 42570335; NR Description: endo/excinuclease amino
  misc_feature: GI Number: 6319705; NR Description: Subunit of a complex, with Slx4p, that hydrolyzes 5' branches from duplex DNA in response to stalled or converging replication forks; function overlaps with that of Sgs1p-Top3p; Slx1p [Saccharomyces cerevisiae]
  misc_feature: GI Number: 31197949; NR Description: ENSANGP00000021811 [Anopheles gambiae] >gi|21291528|gb|EAA03673.1| ENSANGP00000021811
MGRARRGTAAKGKRRPRTAAKAAAVAGDGHEETKDGPEKAAGGGGGFFCCYLLRSLCPRSKSRTYIGFTVNPRRRIRQHNGELRCGAWRTKRGRPWEMMLCIYGFPTNVAALQFEWAWQHPTESLAVRKAAAEFKSLGGIGNKVKLAYTMLNLPSWENLNLTVNFFSTKNTKFTAGCPPLPCHMKTVVSPMEDLPCYVEGLSSEDDIMEPREDEEERDAAVGGDTSDHGLQTMDLGTRIVGGESDTDEFFAPMDRSEVFASRISESSAARPEEEETRSADCDVEYTIDDFGESDTDEFFAPMEGSEVCGSRISESSGAQPVEEETRIADSDVEYYPTDDFSYMEWGGIHETSELHVSRTPPRCSSSSCSDDVAGRSVNCVTGEASPVLKAGSDDGNLFFHEIDVVDLVTPVARYARDCSKVASICPKIIDLTNSPIVIEL

SEQ ID NO: 5261 - DNA, 1840 bp, Triticum aestivum
  misc_feature (1)..(1840): Ceres cDNA ID no. 22005678
  misc_feature (1)..(1840): Ceres CLONE  ID no. 935443
  misc_feature (1)..(1840): Also known as  Ceres CDNA ID no. 23433839
cgatctccgcctccccacctccaccgccatggatccggcgccgcagtcccaccccatcctctcctacgtgctctcccgcctccccaccctctccaagcccaggcccgccgccggggccgacttcgacatcgagcagccgccggtccacacgccgtccccgcgctcgccctccgtcggcgagttcgagctcgtcgagcggatgccgggcctccgccacgcctccgtgctccacgccatgacccgcgccgtcgccgacgtctccgccgcccgctccgcgctccaggagctgggcccgcgccccgaccacgagctcatcgactcctcccgcgccgtcgtcgccgccgccgccgccggcgacgtcgccccgcggatcaccgaggaggacctcgaggcgtgccgcaccgtggtgcggctcgaggaggcccacgacacttacgaggcgctgctgcaggaggccgaggagaggctcgagaaggtctaccggtcggcgatggagggcagggacctggaggaggctgaggggaaggatgaatcggcggcgggcgctgatgaggtggcggtgcaggaggaagtcgtcgccgtgctgaagcaggcccaggagggcaagccggtggagagcgtgctcctcgtggatcggcagctgcgctacctgcccgaggcgttcggaaggatcctgggactccgcgtgcttgacgtatcacacaaccagctccaggttattccagatgctataggggggcttgatcatcttgaagagctccgtcttgcttctaatgccttggtttctcttcctgatactgttggatttctgtccaatctgaagattctgaatgtgtcgactaacaagctgcgaacactgccagacagcatctcaaagtgcaggtcgcttgttgagcttgatgcaagctacaatgggctcacatatctgccaacaaatattggctatgaactgattaatctgcgaaagctctgggtccacatgaacaagctgcgatctcttccatcatctatctgtgagatgcaatcactatacctcctggatgctcatttcaatgaactctgcggtctgccatctgccatagggaagctttccagccttgaaatcctcaacctgagcagcaacttcagcgacatgaaggagctccctttctcattcggtgacctgctgaacctgcgcgaggttgacctcagcaacaaccagatccatgctcttcccgacagttttggccggcttgacaagctagagaagcttaacctggagcagaaccctctgtccatgccaccagcggaggtcgtgaaggaaggtgtagacgctgtgaaagagtacacgtcaaagaggtggcttgatgcattgctcgaggaagaacagaggagcatggcggcggcggcagcagagagcccgcaggcgtcgactcccaaggcttggctggcgcgcagcgtttcctgggtctcggacgttggggggagccttgtgggctatgtcagtggtggccagaccaagtcggagaaagactcgatcctcgaccagcagttctgaaacctcagtttcagaggtgatcaagtatcgtgaatgtatataccatgtttacgaaactctcgagctgggaatcactttgtgttcctgtcgactcagagagatgcacagccttacaagcccctgccctccaaggtggcgtttattttcccattttaactccatttgagggtcatttccatcgaaggccccggttgtgttactgtccaataataatagggctgaaactcggtatacttgctttattagactgtttgcaacggaaattatgcattttgtttgctgaagccaaaaaaaaaaaaaaaa

SEQ ID NO: 5262 - protein, 502 aa, Triticum aestivum
  misc_feature: PFam Name: Extensin_2; PFam Description: Extensin-like region
  misc_feature: PFam Name: Pyr_redox_2; PFam Description: Pyridine
  misc_feature: PFam Name: FH2; PFam Description: Formin Homology 2 Domain
  misc_feature: PFam Name: LMBR1; PFam Description: LMBR1-like membrane protein
  misc_feature: PFam Name: GATase_2; PFam Description: Glutamine
  misc_feature: GI Number: 50910025; NR Description: putative leucine-rich protein [Oryza sativa (japonica cultivar-group)] >gi|46805022|dbj|BAD16887.1| putative leucine-rich protein [Oryza sativa (japonica cultivar-group)] >gi|50726485|dbj|BAD34094.1|
  misc_feature: GI Number: 21700931; NR Description: At1g12970/F13K23_18 [Arabidopsis thaliana] >gi|17063165|gb|AAL32979.1| At1g12970/F13K23_18 [Arabidopsis thaliana] >gi|18391461|ref|NP_563921.1| leucine-rich repeat family protein
  misc_feature: GI Number: 18857654; NR Description: leucine-rich-repeat protein [Helianthus annuus] >gi|1871526|emb|CAA57523.1| leucine-rich-repeat protein [Helianthus annuus]
  misc_feature: GI Number: 30725612; NR Description: At4g26050 [Arabidopsis thaliana] >gi|20260486|gb|AAM13141.1| putative leucine-rich-repeat protein [Arabidopsis thaliana] >gi|22328943|ref|NP_194335.2|
  misc_feature: GI Number: 57868156; NR Description: plant intracellular
MDPAPQSHPILSYVLSRLPTLSKPRPAAGADFDIEQPPVHTPSPRSPSVGEFELVERMPGLRHASVLHAMTRAVADVSAARSALQELGPRPDHELIDSSRAVVAAAAAGDVAPRITEEDLEACRTVVRLEEAHDTYEALLQEAEERLEKVYRSAMEGRDLEEAEGKDESAAGADEVAVQEEVVAVLKQAQEGKPVESVLLVDRQLRYLPEAFGRILGLRVLDVSHNQLQVIPDAIGGLDHLEELRLASNALVSLPDTVGFLSNLKILNVSTNKLRTLPDSISKCRSLVELDASYNGLTYLPTNIGYELINLRKLWVHMNKLRSLPSSICEMQSLYLLDAHFNELCGLPSAIGKLSSLEILNLSSNFSDMKELPFSFGDLLNLREVDLSNNQIHALPDSFGRLDKLEKLNLEQNPLSMPPAEVVKEGVDAVKEYTSKRWLDALLEEEQRSMAAAAAESPQASTPKAWLARSVSWVSDVGGSLVGYVSGGQTKSEKDSILDQQF

SEQ ID NO: 5263 - DNA, 1127 bp, Zea mays
  misc_feature (1)..(1127): Ceres cDNA ID no. 22005684
  misc_feature (1)..(1127): Ceres CLONE  ID no. 984122
  misc_feature (1)..(1127): Also known as  Ceres CDNA ID no. 24396566
gcaggcggttctcacagcacggaggcactcatcagtcatcactagtacttcactagttagctagcaatattcctactcgctaagtagtggagaactggagatcgacatgagccaggggcagccgaggaggcggcagggcgaagagggcatgcacgcgcaggacaagcccgtcaagttcggcgacgtgctcgacgtctcaggcgagctggccgaccagcccgtggctcccagggacgccgcgcggctgcaggccgcggagcagtccgtgctcggcgggacgcagaagggcgggcccgccgccgtcctgcagtccgccgcgacggtcaacgcgcgagcgggccacgtaggcagggctcagaccgcgtgccccgtcgccgacgcgggcgccaccgtcaccgagaccgagctcgcgggccgccgcgtcgtcaccgagtccgtcggcgggcaggtggtggggaagatggtgagcccggcgccggtggcgatgacggacccgccgggcgcgctggagaaggacgccgtcacgatcggccgcgcgctggaggctgtgggcgcgatggtcggtgacaggccggtcgagcagagcgacgcggcggccgtccaggtcgcggagctgtgcgccacggggtccgactccaccgtccccggaggcctggccgcggcggcgcagtcggcggccgaccagaacgcccgcgccacgcgcgacgaggacaaggtcaagctccggaacgtcctctcgaacgcgagggagaagctgccggcggacaagggggcgacgcgggaggacgccgagagggtggtgtccgccgagatacggaacaagctggacatggcgaccacgccgggcggcgtggcggacgcggtgactacagcggcccggctcaaccaggagcgcccgaggccataggtcgtcgtggcctttatatcccatgtggaacagtggaagcgtgcgatcagaagcctgcgcgcggatgagcgtgcttaatagcacagtagcgcgtgccgtttttttttttggacttactaagaaaactacgtacgcttgtaaaaatgcgcgaacgacaccgtgtccgcagtgtatatagcaataaaatcgttgcgcgtgaagttcaaaaaaaaaaaaaaaa

SEQ ID NO: 5264 - protein, 266 aa, Zea mays
  misc_feature: PFam Name: SMP; PFam Description: Seed maturation protein
  misc_feature: PFam Name: Glutenin_hmw; PFam Description: High molecular
  misc_feature: PFam Name: Peptidase_S8; PFam Description: Subtilase family
  misc_feature: PFam Name: eIF-3c_C; PFam Description: Eukaryotic
  misc_feature: GI Number: 50918673; NR Description: putative embryonic cell protein [Oryza sativa (japonica cultivar-group)] >gi|14626282|gb|AAK71550.1| putative embryonic cell protein [Oryza
  misc_feature: GI Number: 81554; NR Description: embryonic abundant protein gD-34 - upland cottoni|18501|emb|CAA31594.1| D-34 Lea protein [Gossypium hirsutum]i|126078|sp|P09444|LE34_GOSHI Late embryogenesis abundant protein-34 (LEA D-34)
  misc_feature: GI Number: 57506542; NR Description: ECP31 protein [Daucus carota]
  misc_feature: GI Number: 18337; NR Description: embryonic cell protein [Daucus carota] >gi|82045|pir||S22500 embryonic protein ecp31 -
  misc_feature: GI Number: 6648966; NR Description: seed maturation protein
MSQGQPRRRQGEEGMHAQDKPVKFGDVLDVSGELADQPVAPRDAARLQAAEQSVLGGTQKGGPAAVLQSAATVNARAGHVGRAQTACPVADAGATVTETELAGRRVVTESVGGQVVGKMVSPAPVAMTDPPGALEKDAVTIGRALEAVGAMVGDRPVEQSDAAAVQVAELCATGSDSTVPGGLAAAAQSAADQNARATRDEDKVKLRNVLSNAREKLPADKGATREDAERVVSAEIRNKLDMATTPGGVADAVTTAARLNQERPRP

SEQ ID NO: 5265 - DNA, 663 bp, Zea mays
  misc_feature (1)..(663): Ceres cDNA ID no. 22005685
  misc_feature (1)..(663): Ceres CLONE  ID no. 986168
  misc_feature (1)..(663): Also known as  Ceres CDNA ID no. 24396511
ttgcatccagattccagagaacaggagaaagaaaagttgcgaaaaaagaacaacaaaaaaggaaacgaaaacgagcgggggagctcgcggaccccaaaaccctaaccccgcggacccacctggcggcggcggcggcggcgatggcggacggcggaggagaaggaggacctcctgcggcgtcggcggcgctcaaggaccaggggaatgagcagttcaaggcggggagctacctcaaggctgccgcgctctacacgcaggccatcaagctcgaccccgacaacgccaccctctacaggttccttccggcgcccccactcctgttctttctccgccgtgccggtggtaaaaaccctagttgcgcgtgcgcccatcctgcgtttggggaagctatggatagctgcggcctgggtgtgtcaaatacgcgtggggtgggagacgaagaaccgtgcgcccccaccgcgtgcgtgatcactgatcagtgtttgactcctgcggtttgagtgtacaacggtagtggggattgcagattgtgtgtgtgtttggtggtggggggtgctgagaggctctgtaagtgagatggagtgtttgtggttgatttgcggcaccacagcggttgttgcgaatatggtgtgatgatttggtggcttaaaaaaaaaaaaaaaa

SEQ ID NO: 5266 - protein, 119 aa, Zea mays
  misc_feature: PFam Name: TPR_1; PFam Description: Tetratricopeptide repeat
MADGGGEGGPPAASAALKDQGNEQFKAGSYLKAAALYTQAIKLDPDNATLYRFLPAPPLLFFLRRAGGKNPSCACAHPAFGEAMDSCGLGVSNTRGVGDEEPCAPTACVITDQCLTPAV

SEQ ID NO: 5267 - DNA, 1295 bp, Zea mays
  misc_feature (1)..(1295): Ceres cDNA ID no. 22005687
  misc_feature (1)..(1295): Ceres CLONE  ID no. 986999
  misc_feature (1)..(1295): Also known as  Ceres CDNA ID no. 24396539
aatcgaaaaaacaccaccgtcagttcagctgagcctgagcatggcgtcgccggcggccgtgctcgtcagcaatggcggtatctccccacacgctccaccttccgccgccgccttcctcgtctccactccgggcgcctacaccaccgcccccggaaccctcctctggtggacacgtcacctccgccgcctcgccgaatccgccacgctcctcgcccgttcccgccccaacctgctcggcctccccctcccccgatcgcgcgccctcgacctcgatttactatccatccattctctcgtgaacccctccgtgcgggtcgccatccgcgagatgcgcacaaggctgcccatgaccaaggacgaggatttggcgctcacggccctggtcaggggagccgatcccatttctggcggtggcggggctggcctcgacgtcttcgtccacgtggggacgtattccccgccgatctttggagaatcgggggccaggcttgccgcggccggcaggggaagggacgccgctgccgccaagtacgcgtcctgggccaggatccggaagagtttggaaaagatgaggcctcctggggtcactgagctcttgctgactaatgacggggatcacattcttgaaggcgctgttacaaacttctttgttgtctgccaacaggaggaatgcgagagcaacggaaaattctctaatcaaacaatggctactaagtttgaagtgcaaacagcaccactgagtgacggagttctccctgggattatgcgtcagatagtgatcgaggtgtgccatgatattggaatcccagtacgagaggtctctccatcgtggtccatgaatgaattctggaaggaagcctttgttacaagtagcttaaggtttatccagcatgtagagtcagttcaagtgcctttattttgggaggacatacaatctaaaacctggagtgatgtaccttgggcggtgaagaagtttcagggtgttggatgcattaccacacagattcagagggaattactgaagagagcaagaagtgataagtacggcgttaacggtctcctttgagttatgatcattgttgttgattcatttgaagggacttcttttccaggcacttaattatttcatttctgctgggacgacactgttaagactgggtttcttgtgtgtataattcagacattttttgtctgctcagtgctgtgtcggccttctacaagctgcaggtagatagccactgggcagtagcgaagcaattccatgcttgtttattactgtaaaaaaaaaaaaaaaa

SEQ ID NO: 5268 - protein, 341 aa, Zea mays
  misc_feature: PFam Name: Aminotran_4; PFam Description: Aminotransferase
  misc_feature: PFam Name: Extensin_2; PFam Description: Extensin-like region
  misc_feature: PFam Name: FH2; PFam Description: Formin Homology 2 Domain
  misc_feature: GI Number: 21553997; NR Description: unknown [Arabidopsis thaliana]
MASPAAVLVSNGGISPHAPPSAAAFLVSTPGAYTTAPGTLLWWTRHLRRLAESATLLARSRPNLLGLPLPRSRALDLDLLSIHSLVNPSVRVAIREMRTRLPMTKDEDLALTALVRGADPISGGGGAGLDVFVHVGTYSPPIFGESGARLAAAGRGRDAAAAKYASWARIRKSLEKMRPPGVTELLLTNDGDHILEGAVTNFFVVCQQEECESNGKFSNQTMATKFEVQTAPLSDGVLPGIMRQIVIEVCHDIGIPVREVSPSWSMNEFWKEAFVTSSLRFIQHVESVQVPLFWEDIQSKTWSDVPWAVKKFQGVGCITTQIQRELLKRARSDKYGVNGLL

SEQ ID NO: 5269 - DNA, 1182 bp, Zea mays
  misc_feature (1)..(1182): Ceres cDNA ID no. 22005688
  misc_feature (1)..(1182): Ceres CLONE  ID no. 988158
  misc_feature (1)..(1182): Also known as  Ceres CDNA ID no. 23826160
ctctccttccggcttccggccccgctcctccccaaaatcccccaaaacctgacgagctggagggccgatccgcggctccccgccgcctgatccgagcagtctactcggcccagccggggatccaagcgggatggggtacttgagctccgtgatcggccaccccaccgatggatcctccgtcagcggcggcggcctcagccagaatggtagatttagctatggctatgcaagctcccctggtaaaagggcatccatggaagacttctatgagacaaaaattgattgtgttgatggtcagatagttggtctttttggagtttttgatggtcatggtggtgctaaggtagcagagtatgttaaagaaaacctgttcaacaatcttgttagtcatccaaagttcatcagtgatactaaagtcgctatagatgatgcttataaaagcaccgacagtgaattcttagaatctgacagtagtcaaaatcaatgcgggtcaactgcatcaactgctgtacttgttggtgatcgtctcttcgtcgcaaatgttggtgactctagggctatcatatgcagggaaggaaatgctattgctgtttcaaaggatcacaagcctgatcaaactgatgagcggcagcgtattgaagatgctggaggttttgtgatgtgggcaggaacatggcgcgttggtggtgtacttgctgtttcgcgtgcttttggtgacaaactcttaaagcaatatgtggttgtggatccggagatccgagaggaagttgttgatgacacactcgagtttcttatccttgcaagtgatgggctgtgggatgtggtctctaacgaggaagctgttgcgatgactagatccattaaggacccagaagaggctgcaaagatgctcttgcaagaggcgtacaagagggagagcagtgacaacataacttgcgtcgtcgtgcacttcttgcatgggcaaggtagcagcggatacgcttaaagcgtagcagtaaaattattttacgcagtggtgtgctctgatgtacatgcgtcgattgatttcccgatgttaaatggagaaacgtaactacgtaaggtaggaaacgtgtattatgatgggttgaactgggaaatgcgtgtaccctatactatatatatatactgtagtgtggtcgcggacgaaaaaaaaaaaaaaaa

SEQ ID NO: 5270 - protein, 284 aa, Zea mays
  misc_feature: PFam Name: PP2C; PFam Description: Protein phosphatase 2C
  misc_feature: GI Number: 20146110; NR Description: protein phosphatase 2C
  misc_feature: GI Number: 15238651; NR Description: protein phosphatase 2C,
  misc_feature: GI Number: 48094258; NR Description: protein phosphatase 2C
  misc_feature: GI Number: 8979708; NR Description: protein phosphatase 2C-like protein [Arabidopsis thaliana] >gi|11358728|pir||T50783
  misc_feature: GI Number: 50932911; NR Description: protein phosphatase 2C [Oryza sativa (japonica cultivar-group)] >gi|48475088|gb|AAT44157.1| protein phosphatase 2C [Oryza sativa
MGYLSSVIGHPTDGSSVSGGGLSQNGRFSYGYASSPGKRASMEDFYETKIDCVDGQIVGLFGVFDGHGGAKVAEYVKENLFNNLVSHPKFISDTKVAIDDAYKSTDSEFLESDSSQNQCGSTASTAVLVGDRLFVANVGDSRAIICREGNAIAVSKDHKPDQTDERQRIEDAGGFVMWAGTWRVGGVLAVSRAFGDKLLKQYVVVDPEIREEVVDDTLEFLILASDGLWDVVSNEEAVAMTRSIKDPEEAAKMLLQEAYKRESSDNITCVVVHFLHGQGSSGYA

SEQ ID NO: 5271 - DNA, 914 bp, Zea mays
  misc_feature (1)..(914): Ceres cDNA ID no. 22005690
  misc_feature (1)..(914): Ceres CLONE  ID no. 989197
  misc_feature (1)..(914): Also known as  Ceres CDNA ID no. 23824379
agactacaccgctcttctcccgattcccgaactccacgccacagatctctcgcttttctctcttcttttctctccgtactcttacccccgcaggtcgcaggtcgcagctatggcggaggacgcccccaacgcagccgccgagggcggccagcccgctcctcccgagggatccgccgatgccgccccgtcggctaccgcgggcgccaaggccgcggaggcgctgctcccgtcgctcagcatctggccgccgtcgcagcgcacgcgcgacgccgtggtgcgccgcctcgtgcagacgctcgcggcgcccagcgtcctctcccagcgctacggcgccgtcccggagcccgaggccgagcgcgccgccgcggccgtcgaggccgaggccttcgcggccgcctccaagtccgccgccgccgagtccccggcctctatcgaggaggggattgaggtgctccaggcgtactccaaggaggtcagccgccgcctcctcgagctcgccaagaccaggtccgccgctgcgacggcgcccgccgaggggagcgtgcaggaggccgaggactcgtcggcgactgctccagccgccgaggggagcgtgcaggaggccgaggactcgtcggcgactgctccagccgccgaggaggctgccgtaaaagaggagtaaggcttcggcccgtgctttgatccaccgacagttgctgttattttggcatttggtcggaatgttattcatcgtcccccctgcatatgtttactagtatatctattgtctatctattagagattgcttgtgacaagagtgactgatgtttgttccaagaacatatatagtattaagctatatatcaaccgcgcgtccttcgcattgcaaatgtgaaggttgctcgtgtacgttttcactaaaaaaaaaaaaaaaa

SEQ ID NO: 5272 - protein, 183 aa, Zea mays
  misc_feature: PFam Name: Cupin_1; PFam Description: Cupin
  misc_feature: GI Number: 50938911; NR Description: putative MFP1 attachment factor 1 [Oryza sativa (japonica cultivar-group)] >gi|33146512|dbj|BAC79629.1| putative MFP1 attachment factor 1
  misc_feature: GI Number: 7546727; NR Description: MFP1 attachment factor 1
  misc_feature: GI Number: 7546725; NR Description: MFP1 attachment factor 1
  misc_feature: GI Number: 7546729; NR Description: MFP1 attachment factor 1
  misc_feature: GI Number: 7546731; NR Description: MFP1 attachment factor 1
MAEDAPNAAAEGGQPAPPEGSADAAPSATAGAKAAEALLPSLSIWPPSQRTRDAVVRRLVQTLAAPSVLSQRYGAVPEPEAERAAAAVEAEAFAAASKSAAAESPASIEEGIEVLQAYSKEVSRRLLELAKTRSAAATAPAEGSVQEAEDSSATAPAAEGSVQEAEDSSATAPAAEEAAVKEE

SEQ ID NO: 5273 - DNA, 1442 bp, Zea mays
  misc_feature (1)..(1442): Ceres cDNA ID no. 22005691
  misc_feature (1)..(1442): Ceres CLONE  ID no. 989588
  misc_feature (1)..(1442): Also known as  Ceres CDNA ID no. 23825459
gttcgaacccgccatggccgcctccaagcccctgcggctacgcctcgcggtgccgctcgccctcgccctcctcctcgcgctcgccctcgtcaccaacttcctctgggcctcatcctcccgacgagtctccccgctgtcggccccgtcttcttccagaacggtgatggggaagcgcgccaaggcagtgtggcgcctcaacgccacgtacgcagacttgccggcgccgcactgggactgggaggagatgcccgcggcgcctgtgccacgcctcgacggggcgtcggtgcagattggggatctcctctacgtcttcgccgggtacgggaacatcgaccatgtccattctcatgttgatgtttataatttcacctctaacacatggacccaaaggtttcatatgcccaaggagatggcgcattctcatttaggaatggcctcagatggcagatacatctatgcagtttcaggacagtatggaccacagtgccgcgcctcgattaatcgcaactttgtttttgacactgagactagagagtggcatgggttgccccctttaccacttcctaggtatgcaccagctactcagctttggcgtgggcggctccatgtgatgggtggaggcaaagaggaccgccatgaacctggattggagcattggagccttgctgtcaaggatggcaaggcactggagaacgagtggcgagctgaagtacccataccacgtggtggacctcatagggcgtgtattgtagctaatgataaactatttgtgattggtggacaagagggagactttatggctaaaccaggatcacctatttttaaatgtgtacggaggcatgaggttgtgtatggcgatgtgtatatgctagatgatggagcgaagtggaaggaactgtctccaatgccaaagccagattcccacattgaatttgcatgggttgtcgttaacaactccatagtaattgttggtggaactacagagaagcatcctatcaccaaaaagatgattcttgttggtgaagtcttccgttttgatttggaagcactgacctggtcagtcattgggcgcatgcctttccgaatcaagacagccttagctgggtactgggaggggtggctctattttacttctgggcagcgggatcgtgggcctgataatccagctccaaagaaagttgttggaagtatgtggaggacgaggctacacttgtgacggtagaagtgaaagtttttctgaaaattgtagatttgcatctgatttctagtccaacagctaggtccctctcagagaattgcttttatcctgtattttgttgtttggaatgcatattatctatttttactagatattttaaatttaacatttaggctatcagcttgtaaattgcctgaatactaacagcaaaacaatgtaaatactgccaaaaaaaaaaaaaaaa

SEQ ID NO: 5274 - protein, 400 aa, Zea mays
  misc_feature: PFam Name: Kelch_1; PFam Description: Kelch motif
  misc_feature: PFam Name: Kelch_2; PFam Description: Kelch motif
  misc_feature: GI Number: 15912245; NR Description: AT3g27220/K17E12_4
  misc_feature: GI Number: 28416695; NR Description: At1g51540 [Arabidopsis
  misc_feature: GI Number: 66781858; NR Description: Kelch repeat:Kelch [Deinococcus geothermalis DSM 11300] >gi|66797735|ref|ZP_00396493.1| Kelch repeat:Kelch [Deinococcus
MAASKPLRLRLAVPLALALLLALALVTNFLWASSSRRVSPLSAPSSSRTVMGKRAKAVWRLNATYADLPAPHWDWEEMPAAPVPRLDGASVQIGDLLYVFAGYGNIDHVHSHVDVYNFTSNTWTQRFHMPKEMAHSHLGMASDGRYIYAVSGQYGPQCRASINRNFVFDTETREWHGLPPLPLPRYAPATQLWRGRLHVMGGGKEDRHEPGLEHWSLAVKDGKALENEWRAEVPIPRGGPHRACIVANDKLFVIGGQEGDFMAKPGSPIFKCVRRHEVVYGDVYMLDDGAKWKELSPMPKPDSHIEFAWVVVNNSIVIVGGTTEKHPITKKMILVGEVFRFDLEALTWSVIGRMPFRIKTALAGYWEGWLYFTSGQRDRGPDNPAPKKVVGSMWRTRLHL

SEQ ID NO: 5275 - DNA, 1040 bp, Zea mays
  misc_feature (1)..(1040): Ceres cDNA ID no. 22005692
  misc_feature (1)..(1040): Ceres CLONE  ID no. 992224
  misc_feature (1)..(1040): Also known as  Ceres CDNA ID no. 23841531
cacatgttccgacacttgagccaacatgtcacgcagtcgctttgaccttccctgcgctgcgccgacccccaaactctccaaccccccaaaacccaagcccctgcgaccccgagataccaaagccagcagaagaagggatgcagcagccgatgcacatgcagccgcaggcgccggcgataaccccagctgccggaatcaccacggagcagatccaaaagtatctggatgagaataagcagcttattttggctattttggaaaatcagaacctaggaaaattggcagaatgtgctcagtatcaatcacaacttcagaagaacctcttgtatctcgctgcaatcgcagatgcccaaccgcagactgctgtaagccgccctcagatggcgccgcctggtggatcgcctggagtagggcagtacatgtcacaggtgcctatgttcccaccgaggacacctctaacaccccagcagatgcaggagcagcagcttcagcagcagcaggctcagttgctaaacttcagtggccaaatggttgctagaccaggcatggtcaacggcatggtgtccatgcaagctcagctaccaccgggtgtgaacaagcaggatgctggtggggtcgcctctgagccctcgggcaccgagagccacaggagcactggtggtgacgatggtggaagcgactaggccaagaagtcctgataattttacgagctagccttttaggtcgcgaaatatgcatgtatactaccgacgacgaagagaggatcattcctgtgccctttaatggtgagtggccgtgatcttcgcatggatgatgatcattccacctttgttgtcagtcctgtagaacagacgtgggttgttgtgacttttatttgtgtgttttttcccacactgtactgttgtaggctcgaagccatatgttagcttatggtttcaggagctggattcagttacgagcgagttgtgacagcaaaacttttatgaatgacgttagaagtttcaaaaaaaaaaaaaaaaaaaaaaaaaaaaaaaaaaaaa

SEQ ID NO: 5276 - protein, 181 aa, Zea mays
  misc_feature: PFam Name: SSXT; PFam Description: SSXT protein (N-terminal
  misc_feature: GI Number: 21539892; NR Description: GRF1-interacting factor 2 [Arabidopsis thaliana] >gi|20857112|gb|AAM26700.1| At1g01160/F6F3_1 [Arabidopsis thaliana] >gi|6715636|gb|AAF26463.1| T25K16.15 [Arabidopsis thaliana]
  misc_feature: GI Number: 21539894; NR Description: GRF1-interacting factor 3 [Arabidopsis thaliana] >gi|15450537|gb|AAK96446.1| AT4g00850/A_TM018A10_22 [Arabidopsis thaliana] >gi|14190377|gb|AAK55669.1| AT4g00850/A_TM018A10_22 [Arabidopsis
MQQPMHMQPQAPAITPAAGITTEQIQKYLDENKQLILAILENQNLGKLAECAQYQSQLQKNLLYLAAIADAQPQTAVSRPQMAPPGGSPGVGQYMSQVPMFPPRTPLTPQQMQEQQLQQQQAQLLNFSGQMVARPGMVNGMVSMQAQLPPGVNKQDAGGVASEPSGTESHRSTGGDDGGSD

SEQ ID NO: 5277 - DNA, 689 bp, Zea mays
  misc_feature (1)..(689): Ceres cDNA ID no. 22005693
  misc_feature (1)..(689): Ceres CLONE  ID no. 992801
  misc_feature (1)..(689): Also known as  Ceres CDNA ID no. 24396488
cttactattaaaccaagccatggactgagctaaaccaaaacaccgagaaaagaagatagacggatcctcccggtgaacgaacatgtcgccaagagagtggatccacgacggagactacaccccggtatcgtggtcatgattttcattgtgctgctcacagtcgcgtccgtgcttttctcccattattgcgtcggggaccgggcgttcatgcgcactggttatgactttgaaggctatgtgatgcgcaagttcgccgtttgcgtcgacagtggccttcccaagcgggcacatcatgatataaagaatacaaaccctcatgaggttagggttgaggtcgtggaagaggtgcatgcatcagagccctctactcctgctcttcctcttgctacgcctgctcctcctactgctccttaccatgttgctacgggagcaagagcagaagaagtaccatcggcggccgaggaggagcaggaggaagatgaggactgggaggatgatggcgacgatgaagaatttgatttcgaggaagaaggagaccttctaaacctatgatctaggtttgcggaacttctagggtcctttaaaactagccttcatgtgtttcttaaaatatacccttttcaaggtattcaaggggcaacgaatctgatcatggaggatcgagaataatgacaaaaaaaaaaaaaaaa

SEQ ID NO: 5278 - protein, 138 aa, Zea mays
MIFIVLLTVASVLFSHYCVGDRAFMRTGYDFEGYVMRKFAVCVDSGLPKRAHHDIKNTNPHEVRVEVVEEVHASEPSTPALPLATPAPPTAPYHVATGARAEEVPSAAEEEQEEDEDWEDDGDDEEFDFEEEGDLLNL

SEQ ID NO: 5279 - DNA, 1460 bp, Zea mays
  misc_feature (1)..(1460): Ceres cDNA ID no. 22005694
  misc_feature (1)..(1460): Ceres CLONE  ID no. 993515
  misc_feature (1)..(1460): Also known as  Ceres CDNA ID no. 23826733
agagtttcccgcatcggcctccgccacccaccgccgccgccgccccgccccgccccgccaaaggaacggaggatggaagccccgggctcgccctacgcctcctcgccggaatccgcccccaagcgtgcccctcgctccccaccgcagcagcagcctccctccgaggaaggagatgacaaggagaaaccaatacatttgaggtttctggtgtctaatgcgtcagcaggatgtatcattggcaagggtggatcaactattaatgactttcagtcccaatctggggctcgtattcagttatcacgtagccatgagtttttccctggtactaatgacagaatcatcatggtttctggactgtttggtgaagtaatgaaggccatggagttgattcttgagaaacttttggctgagggtgaagaattcaatgaagctgaagctagacctaaagttagacttgtagttcctaacaactcttgtggcgggataattggtaaaggtggagcaacaataaagtcatttattgaagaatcacatgctggaatcaaaatttcgccacaggataacaattatgttggtttgcatgataggcttgttacagttacaggaacctttgataatcagatgaatgcgatagatttgatactgaaaaagttatctgaggatgttcactacccagctaatttgagctccccatttccatatgcaggtcttactttcccaagctaccctggtgttcctgttggttatatgattccgcaggtgccatataataatgctgtgaactatggacctaataacgggtatggaggaaggtaccaaaacaacaagcccagtacacctatgagatctcctgctagtaatgaagcccaagaatctctgaccattggtattgccgatgaacacattggtgctgttgtaggacgtgctggaaggaacataacagagattattcaggctagtggtgctcggatcaagatatcggataggggtgacttcatatctgggacatctgacaggaaggtgacgattactggaacatcagaagctatccggaccgcggagtccatgatcatgcagagggtgtcagccagttcggagaggctatgataccagatatgtttgacggactgtgggggccgttgttgagtccgagcagcatgtttgatgcaagttattattgtttgttgcgttgcgccaatggtttagtcgaagatatataggtgcagcgtttgaatggatttgggaatagggctgagttatatcccgtggatgccacaacaaggcaggcaggcgccgctctgtgctagtggctgagtaggttgacaattcggtatgttgatttcctggtacccccccttcctttttttttgagtcttgtgtatgtagatctgagtatgggttctttctttcacgtggccagaaagagcatggttggaagctaaagaaaaaaaaaaaaaaaa

SEQ ID NO: 5280 - protein, 1460 aa, Zea mays
  misc_feature: PFam Name: KH_1; PFam Description: KH domain
  misc_feature: GI Number: 50915982; NR Description: KH domain-containing protein NOVA-like [Oryza sativa (japonica cultivar-group)] >gi|48716278|dbj|BAD22893.1| KH domain-containing protein NOVA-like [Oryza sativa (japonica cultivar-group)] [Oryza sativa
  misc_feature: GI Number: 30680512; NR Description: KH domain-containing
  misc_feature: GI Number: 23507775; NR Description: At5g04430/T32M21_30 [Arabidopsis thaliana] >gi|21554568|gb|AAM63617.1| putative RNA-binding protein [Arabidopsis thaliana] >gi|7406447|emb|CAB85549.1| putative RNA-binding protein
  misc_feature: GI Number: 30230625; NR Description: neuro-oncological ventral antigen 1-like protein [Rattus norvegicus] >gi|33516919|sp|Q80WA4|NOA1_RAT RNA-binding protein Nova-1
  misc_feature: GI Number: 49258011; NR Description: MGC84002 protein
AGAGTTTCCCGCATCGGCCTCCGCCACCCACCGCCGCCGCCGCCCCGCCCCGCCCCGCCAAAGGAACGGAGGATGGAAGCCCCGGGCTCGCCCTACGCCTCCTCGCCGGAATCCGCCCCCAAGCGTGCCCCTCGCTCCCCACCGCAGCAGCAGCCTCCCTCCGAGGAAGGAGATGACAAGGAGAAACCAATACATTTGAGGTTTCTGGTGTCTAATGCGTCAGCAGGATGTATCATTGGCAAGGGTGGATCAACTATTAATGACTTTCAGTCCCAATCTGGGGCTCGTATTCAGTTATCACGTAGCCATGAGTTTTTCCCTGGTACTAATGACAGAATCATCATGGTTTCTGGACTGTTTGGTGAAGTAATGAAGGCCATGGAGTTGATTCTTGAGAAACTTTTGGCTGAGGGTGAAGAATTCAATGAAGCTGAAGCTAGACCTAAAGTTAGACTTGTAGTTCCTAACAACTCTTGTGGCGGGATAATTGGTAAAGGTGGAGCAACAATAAAGTCATTTATTGAAGAATCACATGCTGGAATCAAAATTTCGCCACAGGATAACAATTATGTTGGTTTGCATGATAGGCTTGTTACAGTTACAGGAACCTTTGATAATCAGATGAATGCGATAGATTTGATACTGAAAAAGTTATCTGAGGATGTTCACTACCCAGCTAATTTGAGCTCCCCATTTCCATATGCAGGTCTTACTTTCCCAAGCTACCCTGGTGTTCCTGTTGGTTATATGATTCCGCAGGTGCCATATAATAATGCTGTGAACTATGGACCTAATAACGGGTATGGAGGAAGGTACCAAAACAACAAGCCCAGTACACCTATGAGATCTCCTGCTAGTAATGAAGCCCAAGAATCTCTGACCATTGGTATTGCCGATGAACACATTGGTGCTGTTGTAGGACGTGCTGGAAGGAACATAACAGAGATTATTCAGGCTAGTGGTGCTCGGATCAAGATATCGGATAGGGGTGACTTCATATCTGGGACATCTGACAGGAAGGTGACGATTACTGGAACATCAGAAGCTATCCGGACCGCGGAGTCCATGATCATGCAGAGGGTGTCAGCCAGTTCGGAGAGGCTATGATACCAGATATGTTTGACGGACTGTGGGGGCCGTTGTTGAGTCCGAGCAGCATGTTTGATGCAAGTTATTATTGTTTGTTGCGTTGCGCCAATGGTTTAGTCGAAGATATATAGGTGCAGCGTTTGAATGGATTTGGGAATAGGGCTGAGTTATATCCCGTGGATGCCACAACAAGGCAGGCAGGCGCCGCTCTGTGCTAGTGGCTGAGTAGGTTGACAATTCGGTATGTTGATTTCCTGGTACCCCCCCTTCCTTTTTTTTTGAGTCTTGTGTATGTAGATCTGAGTATGGGTTCTTTCTTTCACGTGGCCAGAAAGAGCATGGTTGGAAGCTAAAGAAAAAAAAAAAAAAAA

SEQ ID NO: 5281 - DNA, 851 bp, Zea mays
  misc_feature (1)..(851): Ceres cDNA ID no. 22005697
  misc_feature (1)..(851): Ceres CLONE  ID no. 998445
  misc_feature (1)..(851): Also known as  Ceres CDNA ID no. 23825245
ggttaactttcacgtccggatgcaaattcgcctcggtcgttcaaccaaacaagctcactcccggccatcaggcgcacaccgctctcccgccgccgtcctgcgtcggagcgatatccctacatccccacctcatttgcacccggattggcttcttcttctactactactggaactctctttgcgatcccaaaatcgcaaaataaaggtaaatcaaaaggaaccgacttaggagctggaatgacatctaggagctttacgaaggaagagatctctaaacataacacaaggaaggactgttggatcgtcatcaaggacaaggtctatgatgtcactccttatgtagaggagcatccaggcggagatgccattctaaataatgctggtggtgattccacagagggcttttttgggccacagcacggcactagggtcttcgatatcatcgaggatttctgcatcggtcagttgaaggcatagggtagcttgtattgaattcgtggaattttccggaaatcaagttttgagaagctacatgttatccaacattttaagcattgcaaccttcaagcatttgagatgccagtataattgttccacaattgtcatcggggctgctaggagctgtgatgtagcacttcgtttttattctgctgttgtgtgactgtgtctttacatttctgttgttggacaagactccaaaacgcttgtaattgttctggctaagggcccgttcggttattcaggaatctactccagaaaggatttcagctggaataattgtataatttgtataacaattagtaacctggaatagttcctagtcttgttccagcctaaaaaaaaaaaaaaaa

SEQ ID NO: 5282 - protein, 79 aa, Zea mays
  misc_feature: PFam Name: Cyt-b5; PFam Description: Cytochrome b5-like
  misc_feature: GI Number: 22137120; NR Description: At1g60660/F8A5_18 [Arabidopsis thaliana] >gi|15146312|gb|AAK83639.1| At1g60660/F8A5_18 [Arabidopsis thaliana] >gi|2462759|gb|AAB71978.1| Putative Cytochrome B5 [Arabidopsis
  misc_feature: GI Number: 55845943; NR Description: nitrate reductase
  misc_feature: GI Number: 25044825; NR Description: cytochrome b5 [Ananas comosus]
  misc_feature: GI Number: 10834811; NR Description: cytochrome b5 [Rhizopus
  misc_feature: GI Number: 50911308; NR Description: putative cytochrome b5 [Oryza sativa (japonica cultivar-group)] >gi|49387865|dbj|BAD26552.1| putative cytochrome b5 [Oryza sativa
MTSRSFTKEEISKHNTRKDCWIVIKDKVYDVTPYVEEHPGGDAILNNAGGDSTEGFFGPQHGTRVFDIIEDFCIGQLKA

SEQ ID NO: 5283 - DNA, 965 bp, Zea mays
  misc_feature (1)..(965): Ceres cDNA ID no. 22005698
  misc_feature (1)..(965): Ceres CLONE  ID no. 998519
  misc_feature (1)..(965): Also known as  Ceres CDNA ID no. 23825002
aatacaaaccacacggcacacacacaaccaccggcccttctctcctcggctcacccagcaggccgcgccggatgctcatggccgcagccacgcactacttgggcggatcagcccactcctcctccaccacctcctcctccatctcgccatcgccgccgccctggcacccggtcctagtcgtacccagcaaccagcgccaggccgtcgtctacgacctaacggaggacctcgccacgccgccgtccccgtccccgtccccgtcaacgaccccgcagcacctccgccccgcgtcccggcggcgcgcgggcaagccgcgccggccgcggccgtcgcggaagctgcccaccacctacatcagcgccgacgccgccagcttccggcgcatggtgcaccaggtgacgggcgccggcgtcggcgccgacgtcgacgcggtgcaccagggcacggagcagctgctctgccgcccggcaccgccctcccgcgctgtgctttcgacggcgacgacgacgctggtgccgacgctggacacgtcggcgttcctgctcgacgccgggggtggcgggcggcctggcgcggcctgcttccacggctccgcggcggcggcggaggcggaggcctgtggttgtggtggcggcggcggcataggaggaggaggggagtacagttgcagcaacggcggcggcggcgggttcccgagcttggagtcgtgggatgaccacgacctattctaggactaggaaggagtagctgccgtctccaaaactccatggccgtgcacacctagcttgcttgtactgtagattatttgagcttaccacagcatccatcgattgattgatcgacaagcagcgtgattatattggttacagagtttgctgctagctatcttggtcgatcaagctttgttgctgtgggaatatgatgtgatgagatggagtaaaaaaggatcaaaaaaaaaaaaaaaa

SEQ ID NO: 5284 - protein, 219 aa, Zea mays
  misc_feature: PFam Name: FH2; PFam Description: Formin Homology 2 Domain
  misc_feature: GI Number: 32141270; NR Description: probable translational initiation factor [Streptomyces coelicolor A3(2)] >gi|39931282|sp|Q8CJQ8|IF2_STRCO Translation initiation factor IF-2 >gi|24413891|emb|CAD55362.1| probable translational
  misc_feature: GI Number: 34872074; NR Description: similar to Ser/Arg-related nuclear matrix protein; plenty-of-prolines-101;
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 7949115; NR Description: Ser/Arg-related nuclear matrix protein; plenty-of-prolines-101; serine/arginine repetitive matrix protein 1 [Mus musculus] >gi|3153821|gb|AAC17422.1|
  misc_feature: GI Number: 27375632; NR Description: blr0521 [Bradyrhizobium japonicum USDA 110] >gi|27348769|dbj|BAC45786.1| blr0521
MLMAAATHYLGGSAHSSSTTSSSISPSPPPWHPVLVVPSNQRQAVVYDLTEDLATPPSPSPSPSTTPQHLRPASRRRAGKPRRPRPSRKLPTTYISADAASFRRMVHQVTGAGVGADVDAVHQGTEQLLCRPAPPSRAVLSTATTTLVPTLDTSAFLLDAGGGGRPGAACFHGSAAAAEAEACGCGGGGGIGGGGEYSCSNGGGGGFPSLESWDDHDLF

SEQ ID NO: 5285 - DNA, 1200 bp, Zea mays
  misc_feature (1)..(1200): Ceres cDNA ID no. 22005699
  misc_feature (1)..(1200): Ceres CLONE  ID no. 999099
  misc_feature (1)..(1200): Also known as  Ceres CDNA ID no. 23825373
cttttcacttccctccctccctccctttcctctcctccccgctccatggcccccgcggcgccagcgggcctggcctccgtcgcggtcgcggtcgcggttgccgtgctcgccgccgcggcgtcggcggccgtcacctacgaccgcaaggccgtcgtggtgaacggccagcgccggatcctgatgtccggctccatccactacccaaggagcgtccccgagatgtggccggatctgatacagaaggccaaggacggcggcctcgacgtcgtgcagacgtacgtcttctggaacggccatgagccctcccgtcgacagtactacttcgagggtcggtatgatctggtgcacttcatcaagctggtgaagcaggccggactctacgtgcacctccgcattggcccctacgtctgcgccgagtggaatttcggtggtttccctgtttggctcaagtatgtcccgggcattagctttaggactgataatgaaccgttcaaggctgagatgcagaatttcaccacaaagatcgttgacatgatgaagtccgaagggctctttgaatggcagggagggccaataattctttcccagattgagaatgaatttgggcccttggagtgggatcagggagagcccgccaaggcctatgcgtcatgggcagctaacatggcggttgcgctcaacacaagtgttccatgggtcatgtgcaaagaagatgatgccccggatccaattattaatacttgcaatggattttattgtgactggttctccccaaacaaacctcacaagcctacaatgtggactgaggcttggacatcttggtatacaggatttggtattccagttccacatagaccagtagaggatctagcatatggtgtggccaagtttattcagaagggtggctcttttgttaattattacatgtatcatggtggaacaaattttgggcgcacagctggtggtccattcattgcaactagctacgactatgatgctcctattgatgaatatggtgagctgaacacattctactttggtaaaaggcatgcattatacagtttgcatcaacctcctctcatgtaaggattactgctacgtaatttcccataatgtatcatgtatacatgattccatagatgctataaggttgatttaatagtactccccagtcatcttcaatgaaaaaaaaaaaaaaaa

SEQ ID NO: 5286 - protein, 346 aa, Zea mays
  misc_feature: PFam Name: Glyco_hydro_35; PFam Description: Glycosyl
  misc_feature: GI Number: 16604400; NR Description: At1g45130/F27F5_20
  misc_feature: GI Number: 20334754; NR Description: At1g45130/F27F5_20 [Arabidopsis thaliana] >gi|17979002|gb|AAL47461.1| At1g45130/F27F5_20 [Arabidopsis thaliana] >gi|15219534|ref|NP_175127.1| beta-galactosidase, putative /
  misc_feature: GI Number: 7682677; NR Description: beta galactosidase [Vigna
  misc_feature: GI Number: 7682680; NR Description: beta galactosidase [Vigna
  misc_feature: GI Number: 2209358; NR Description: beta-D-galactosidase
MAPAAPAGLASVAVAVAVAVLAAAASAAVTYDRKAVVVNGQRRILMSGSIHYPRSVPEMWPDLIQKAKDGGLDVVQTYVFWNGHEPSRRQYYFEGRYDLVHFIKLVKQAGLYVHLRIGPYVCAEWNFGGFPVWLKYVPGISFRTDNEPFKAEMQNFTTKIVDMMKSEGLFEWQGGPIILSQIENEFGPLEWDQGEPAKAYASWAANMAVALNTSVPWVMCKEDDAPDPIINTCNGFYCDWFSPNKPHKPTMWTEAWTSWYTGFGIPVPHRPVEDLAYGVAKFIQKGGSFVNYYMYHGGTNFGRTAGGPFIATSYDYDAPIDEYGELNTFYFGKRHALYSLHQPPLM

SEQ ID NO: 5287 - DNA, 672 bp, Zea mays
  misc_feature (1)..(672): Ceres cDNA ID no. 22005700
  misc_feature (1)..(672): Ceres CLONE  ID no. 999423
  misc_feature (1)..(672): Also known as  Ceres CDNA ID no. 23856262
aaaaaaccctaatcgcatctgcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggctacattggcgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacatcgtcctaacaacttctgctggaattatggaccatgaggaggcccgccgtaagaatgttggtggcaaggttctaggtttcttttattgaaaatgtgtttttttgagccacagatgcgtccaagaactcgtctgatgttttgaggtttgttaagactgggtgtccgagcctttgtggtttgttaagacagcgatgtgtcatgtatttcagaaattgggatttttatgagatgtacctgcgagagccctgtctgtttcgattttaaaaaaaaaaaaaaaa

SEQ ID NO: 5288 - protein, 130 aa, Zea mays
  misc_feature: PFam Name: Ribosomal_S8; PFam Description: Ribosomal protein S8
  misc_feature: GI Number: 23397065; NR Description: putative cytoplasmic ribosomal protein S15a [Arabidopsis thaliana] >gi|21593909|gb|AAM65874.1| cytoplasmic ribosomal protein S15a-like [Arabidopsis thaliana] >gi|21593169|gb|AAM65118.1|
  misc_feature: GI Number: 17863; NR Description: r-protein BnS15a [Brassica napus] >gi|99825|pir||S20945 ribosomal protein S15a - rape
  misc_feature: GI Number: 6683481; NR Description: wrp15a [Citrullus lanatus]
  misc_feature: GI Number: 50935123; NR Description: ribosomal protein S15 [Oryza sativa (japonica cultivar-group)] >gi|28411802|dbj|BAC57277.1| ribosomal protein S15 [Oryza sativa
MVRVSVLNDALKSMYNAEKIGKRQVMIRPSSKVIIKFLTVMQRHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 5289 - DNA, 1380 bp, Zea mays
  misc_feature (1)..(1380): Ceres cDNA ID no. 22005702
  misc_feature (1)..(1380): Ceres CLONE  ID no. 999757
  misc_feature (1)..(1380): Also known as  Ceres CDNA ID no. 23826364
gtgtgtcatttctctctgacgggtgagatttggtttggatctggtcggaccaggtgctccacgcgatggcgcagaaggagactaatggcagcaacggcgatcacatctccacccgcccgccgccgaccccctcgcccctccgcttctccaagttctttcaggctaacctgcggatcctggtcactggtggggcgggcttcatcggctcgcacctcgtagacaagctcatggagaacgagaagcacgaggtcattgttgctgataactttttcactggttcaaaagacaacctgaagaagtggattggccacccaagatttgagctcatccgtcatgatgtcaccgagccgcttcttgtggaagttgaccaaatctatcaccttgcttgccctgcttcaccaatcttctacaagcacaaccctgttaagaccatcaagacaaatgttattggtaccctgaacatgctaggacttgcaaagagagttggagctaggattttgttgacatcaacctctgaagtttatggtgatccacttgagcatcctcaaactgaggcctactggggcaatgttaacccgattggtgttaggagttgttatgatgagggtaagcgtgtagcagagacgctgatgttcgactatcacaggcagcatggcattgaaatccggattgccaggattttcaacacctatgggcctaggatgaacattgatgatggccgtgttgttagcaacttcattgctcaggctgtgcgcggtgagcccctgactgtccagaggccaggaacacagactaggagtttctgctatgttgccgatatggttgatggtcttattaagctgatgaatggaaacaagactggaccgattaacttggggaacccaggtgaattcaccatgctggaacttgctgagaatgtgaaggagttgatcaacccagatgtgacagtgacgatgaccgagaacactcctgatgatccccgccagaggaagccggacatcacaaaggcgaaggaagttctgggatgggagcccaagatcgtcctgcgggacggcttggtgctcatggaggatgatttccgggagcgcctgaccgtgcccaagaaaaccaaggcctaaattgccctgcagttggggaagaatatccacacggggaagcatactcatagtcgggctcgtcattatttgtggccacatttcattacggaatttgagttccaataaacttaatattcctttgtcgttcaccttgaaggattgtattattagaattttcatacagggctggccattcgagtctctgcctacgcagatcttgtggtacttgtgtttgtagccaatgtgtgagtaaaagtcgattatagcaaaaaaaaaaaaaaaa

SEQ ID NO: 5290 - protein, 350 aa, Zea mays
  misc_feature: PFam Name: Epimerase; PFam Description: NAD dependent
  misc_feature: GI Number: 13591616; NR Description: UDP-D-glucuronate
  misc_feature: GI Number: 50659026; NR Description: UDP-D-glucuronate
  misc_feature: GI Number: 48093461; NR Description: UDP-glucuronate
  misc_feature: GI Number: 18447934; NR Description: UDP-glucuronic acid
  misc_feature: GI Number: 11121508; NR Description: d-TDP-glucose
MAQKETNGSNGDHISTRPPPTPSPLRFSKFFQANLRILVTGGAGFIGSHLVDKLMENEKHEVIVADNFFTGSKDNLKKWIGHPRFELIRHDVTEPLLVEVDQIYHLACPASPIFYKHNPVKTIKTNVIGTLNMLGLAKRVGARILLTSTSEVYGDPLEHPQTEAYWGNVNPIGVRSCYDEGKRVAETLMFDYHRQHGIEIRIARIFNTYGPRMNIDDGRVVSNFIAQAVRGEPLTVQRPGTQTRSFCYVADMVDGLIKLMNGNKTGPINLGNPGEFTMLELAENVKELINPDVTVTMTENTPDDPRQRKPDITKAKEVLGWEPKIVLRDGLVLMEDDFRERLTVPKKTKA

SEQ ID NO: 5291 - DNA, 741 bp, Triticum aestivum
  misc_feature (1)..(741): Ceres cDNA ID no. 22005706
  misc_feature (1)..(741): Ceres CLONE  ID no. 1031530
  misc_feature (1)..(741): Also known as  Ceres CDNA ID no. 24412063
aaagccttcccactcccttccctcccatcccagacgccacagacccgacgacggccgccggccggcaagaaggcgtcgtccatggggccccagcaggaccggtcggcgtccaaggcgctcgccaacggcacggcggtggcgcccgagaggaaggacggcaaggtggtgcactacaaggagtgccagcgcaaccacgccgccggcatcggcggctacgccgtggacggctgccgcgagttcatggcgtccgcccccgcgggcgccgaggcgctcctctgcgcggcgtgcggctgccaccgcagcttccacaagcgcgaggtggaggccgtcgagtgcgactgctcctccgacacctccggccggtgatcgccgccgcccgtcgccgcccaagcccgctgttctcttgctggctcgtcacgggtagaccggcatctatcggcaggtaaggcgtggtggacgttgagatgactccattcgatctcgatccatctatcaaatacatatatatggcccggttaatttatcttcttcctcctcctcctcttcctcctggtattgggattaatttggtgctcgattgcgtgtgatgtaattaacatatccgtacgtgtagcatatgcgtgttgatgagagtccaaactggtgcgtgtgtgtgtagatcgatcggtgagatgaacaccttgtaatttgtacagatttgtgtttcttgtttggaaccagcagtcaaaaaaaaaaaaaaaa

SEQ ID NO: 5292 - protein, 94 aa, Triticum aestivum
  misc_feature: PFam Name: ZF-HD_dimer; PFam Description: ZF-HD protein
  misc_feature: GI Number: 21553465; NR Description: unknown [Arabidopsis thaliana]
  misc_feature: GI Number: 5091602; NR Description: 10A19I.6 [Oryza sativa
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 13374061; NR Description: ZF-HD homeobox protein
  misc_feature: GI Number: 53689757; NR Description: ZF-HD homeobox
MGPQQDRSASKALANGTAVAPERKDGKVVHYKECQRNHAAGIGGYAVDGCREFMASAPAGAEALLCAACGCHRSFHKREVEAVECDCSSDTSGR

SEQ ID NO: 5293 - DNA, 844 bp, Triticum aestivum
  misc_feature (1)..(844): Ceres cDNA ID no. 22005708
  misc_feature (1)..(844): Ceres CLONE  ID no. 1033187
  misc_feature (1)..(844): Also known as  Ceres CDNA ID no. 24412532
agacggtgccagagtccacgctccggaagaaaaaggcaccacctttgttcgcccttctcctctccctcgtgacaccactcccagagaaagagagagacagatggcgatgcgggcggtggcggtgctgctgcttctggcggtggcgagcgtgctggcggcgggcgcggcggcgcagtcgacgggcacgccggcgtgcgcgtccaagctgacgggctgcgccggctacatgaacggcacggacgcgcagaagccgccggagacctgctgcggcccgctccgggacgccgtgaagaacgagaagccctgcctctgcgcgctctacgcctcgcccgagatcttcaaggccttcaacatcaacgtcaccgacgcgctccgcctctccaagcgctgcggcgtctccgaggacgtcagcagctgccccagcacctctctgacgaagtctcctccaggttcgagttcttctccatcaggtggcgctccatcaggtggcaagagcgccgggcaccctaccatgtcggccagcttcgcggggctgatgagcctcttcctggtcctgtggtctgcactggcataagaaatcggcgattcggcatgctagacatgttcttctttcggcttatatcccatggtagatgagctgcagctctggtggtagttcttggtggtgtcgccgcgtttgtttttgctgtgtattggttggtgttgccagttcagtagacttgctgtgaataaggatttcggcactctcttcagacctgtgatgaccagagcagagtgggcattgtgtgagacgtatttcggcttcactattttcttttcttttgtatcaaaaaaaaaaaaaaaa

SEQ ID NO: 5294 - protein, 157 aa, Triticum aestivum
  misc_feature: PFam Name: Tryp_alpha_amyl; PFam Description: Protease
  misc_feature: GI Number: 18410388; NR Description: protease inhibitor/seed storage/lipid transfer protein (LTP) family protein [Arabidopsis
  misc_feature: GI Number: 21593596; NR Description: lipid transfer protein,
  misc_feature: GI Number: 46359807; NR Description: At1g62790 [Arabidopsis thaliana] >gi|45476539|gb|AAS65935.1| At1g62790 [Arabidopsis thaliana] >gi|15221585|ref|NP_176467.1| protease inhibitor/seed storage/lipid transfer protein (LTP) family protein [Arabidopsis
  misc_feature: GI Number: 30696757; NR Description: protease inhibitor/seed storage/lipid transfer protein (LTP) family protein [Arabidopsis
MAMRAVAVLLLLAVASVLAAGAAAQSTGTPACASKLTGCAGYMNGTDAQKPPETCCGPLRDAVKNEKPCLCALYASPEIFKAFNINVTDALRLSKRCGVSEDVSSCPSTSLTKSPPGSSSSPSGGAPSGGKSAGHPTMSASFAGLMSLFLVLWSALA

SEQ ID NO: 5295 - DNA, 920 bp, Triticum aestivum
  misc_feature (1)..(920): Ceres cDNA ID no. 22005709
  misc_feature (1)..(920): Ceres CLONE  ID no. 1033379
  misc_feature (1)..(920): Also known as  Ceres CDNA ID no. 23561949
cacaatcaaaacaccgactactcaagggaaatccatggcctctgccgcgctcctcgtcctcctcgccctggccaccatgcaggcgcagaccacgtcgtccgagaaggagacgcacctcaaggtgtactggcacgacgtggtgagcggacaagacccgacatcggtgccggtggcgcgcgcggccacgaccaacacctccaagtcggccttcggcgtcgtcatggtcatggacaactcactcacagaggggccgagcctcgactcatccaggctcatgggccgcgcccagggcacgtacatcgccgccggcaaggaccagctggcgctgctcatgctcatgaacttcgtctttaccgccggaaagtacaacggcagcagcatcgccattgtgggtcgcaacgccgtgtttaccgaggtccgtgagatggctgtcgtcggtggtaccggcgtgttcaggtgggcacgcgggtacgcgcaggccaggacgcataccttagacctcaagaccggcgacgccaccgtcgagtacaacatattcatcaggcactagtctcggccgttgtcaaaatttacttttgaaaacgggtttgctatttcacatctaaatgtgaaatacttatctcacatctaaatctagaacagttgatattgtttgtctttaattttcgtgcaaacatgatcgtctcgcctggcgcacccgttcgcttcacgttgtctgctgcagcggcctgtgtcccggccatgcaagtggtggtgggccgttgttgttcctttttaattcgcgggcttaggctggcagccgttgtttgtctcgattatggactcctgtttacgctttttttactggattgtccacgtatttgttgtctgtataattttttgaagcaatgtgattttagagtggaaaaaaaaaaaaaaaa

SEQ ID NO: 5296 - protein, 171 aa, Triticum aestivum
  misc_feature: PFam Name: Dirigent; PFam Description: Dirigent-like protein
  misc_feature: PFam Name: Cupin_1; PFam Description: Cupin
  misc_feature: PFam Name: Protamine_P2; PFam Description: Sperm histone P2
  misc_feature: GI Number: 62734203; NR Description: Similar to F12P19.3 [imported] - Arabidopsis thaliana [Oryza sativa (japonica
  misc_feature: GI Number: 62734190; NR Description: F12P19.3 [imported] -
  misc_feature: GI Number: 37201988; NR Description: At3g13650 [Arabidopsis thaliana] >gi|9294009|dbj|BAB01912.1| disease resistance response protein-like [Arabidopsis thaliana] >gi|26451116|dbj|BAC42662.1|
  misc_feature: GI Number: 6227011; NR Description: F12P19.3 [Arabidopsis thaliana] >gi|15218836|ref|NP_176762.1| disease resistance-responsive family protein [Arabidopsis thaliana]
  misc_feature: GI Number: 62734205; NR Description: disease resistance response protein/dirigent protein, putative [Oryza sativa (japonica
MASAALLVLLALATMQAQTTSSEKETHLKVYWHDVVSGQDPTSVPVARAATTNTSKSAFGVVMVMDNSLTEGPSLDSSRLMGRAQGTYIAAGKDQLALLMLMNFVFTAGKYNGSSIAIVGRNAVFTEVREMAVVGGTGVFRWARGYAQARTHTLDLKTGDATVEYNIFIRH

SEQ ID NO: 5297 - DNA, 1622 bp, Glycine max
  misc_feature (1)..(1622): Ceres cDNA ID no. 22005711
  misc_feature (1)..(1622): Ceres CLONE  ID no. 1043928
  misc_feature (1)..(1622): Also known as  Ceres CDNA ID no. 24402149
atcccaatagtagctgtgtgttgtgctcaccaatacagtactatgatttcaagtggactgaaaccgaagcacttcaacaacgttcattcgctcttcaatctttccaaatcccaacaacccccaaatccaattatagtcccatgctgccgaaccaacaccaacaataacatctcttctccattctccattcgtttcaattcgcctttcccataccggagccccaagattcccctaaaatgtgcaccgctgcactcttcagattccctgccacccgatccttcctctgcctcgacccagatggagcaaaattcaatgtcaattctggagattcttaagcaatcaaattcatatctgcctcatgcactcattgcaagtatactgctagctctaatctacccacgttctttaacgtggtttaccagcagattctatgcacctgcactaggttttttgatgtttgctgttggggttaattcaaatgaaaatgacttccttgaggcattcaagaggccagcagaaattgtcactggttattttggccagtttgctgtgaagcctcttcttggatatctgttttgcatgattgcagtaactgttttaggcctaccaacaacagtaggcgcaggaattgtattggtggcttgtgttagtggtgctcagctttcaagttatgctactttcctgactgatccacaaatggcacctttaagcatagttatgacatcactgtccactgcttctgcagtttttgtcacgccactcttattactgttgctcattgggaagaaattgcctatagatgtaaaaggaatggtgtataacattacacagattgtggttgtgcctattgcagctggcctgcttctaaatcgattctttcctcgtatttgtaatgttattcgaccatttttgcctccgctatctgtactggtggcatctatctgtgccggagcgccacttgccttaaatgttgagactatgaaatcccccttgggagtcgctatcttgttgcttgttgttgcttttcatttgtcatcttttatagctggttatatcctcagtgggtttgtcttccgcgattctcttgatgtgaaggcactgcaacgaacaatttcctttgagacaggcatgcaaagtagcctgcttgccctggctcttgctaataagttcttcgaagatccaaaagtggctattcctccagcaatttctacttcaattatgtctttgatgggatttgttctggtgctgatttggaccagaagagggaagagcgagataaaaaacagctcctgaaaggtatggatatcgggatatatgttactgctaattggtccatcttttgttctagtgagcatcggttctgcttactaggagggaacaatggcagtcatagtgataatgtattaatatcatattatctattcatgactagtagcctgtttcttttagattttaggaacctcaaataagaagtttgttgtgatcaatgaaattcagttcatcagtaacttctgtggtttaatttttactttgttgaaagaacaaaccaaggtggtatggtatgtaacgtacgccagttcctcaagttttagttgccgttggatttaaaaaaaaaaaaaaaa

SEQ ID NO: 5298 - protein, 416 aa, Glycine max
  misc_feature: PFam Name: SBF; PFam Description: Sodium Bile acid symporter
  misc_feature: GI Number: 42572883; NR Description: bile acid:sodium
  misc_feature: GI Number: 20453271; NR Description: AT3g20560/K10D20_9 [Arabidopsis thaliana] >gi|15215839|gb|AAK91464.1| AT4g12030/F16J13_100 [Arabidopsis thaliana] >gi|18413732|ref|NP_567385.1| bile acid:sodium symporter family
  misc_feature: GI Number: 50908255; NR Description: bile acid:sodium symporter-like [Oryza sativa (japonica cultivar-group)] >gi|47848126|dbj|BAD21908.1| bile acid:sodium symporter-like [Oryza
  misc_feature: GI Number: 21554890; NR Description: unknown [Arabidopsis thaliana]
  misc_feature: GI Number: 51457946; NR Description: putative anion:sodium
MISSGLKPKHFNNVHSLFNLSKSQQPPNPIIVPCCRTNTNNNISSPFSIRFNSPFPYRSPKIPLKCAPLHSSDSLPPDPSSASTQMEQNSMSILEILKQSNSYLPHALIASILLALIYPRSLTWFTSRFYAPALGFLMFAVGVNSNENDFLEAFKRPAEIVTGYFGQFAVKPLLGYLFCMIAVTVLGLPTTVGAGIVLVACVSGAQLSSYATFLTDPQMAPLSIVMTSLSTASAVFVTPLLLLLLIGKKLPIDVKGMVYNITQIVVVPIAAGLLLNRFFPRICNVIRPFLPPLSVLVASICAGAPLALNVETMKSPLGVAILLLVVAFHLSSFIAGYILSGFVFRDSLDVKALQRTISFETGMQSSLLALALANKFFEDPKVAIPPAISTSIMSLMGFVLVLIWTRRGKSEIKNSS

SEQ ID NO: 5299 - DNA, 1541 bp, Glycine max
  misc_feature (1)..(1541): Ceres cDNA ID no. 22005712
  misc_feature (1)..(1541): Ceres CLONE  ID no. 1044964
  misc_feature (1)..(1541): Also known as  Ceres CDNA ID no. 24403132
aactgtccccagtaatcagtatatataaagatcttcttctctcccatttttcatattcctatgtgcaagacaaagatggcaaccaacgcggccagtcccactcgcactccacgctcccaacaacgccccacccaaagcccaaggacaccctcgtcaaggcccacgctcaggcccacctctttctccaacaatccctccacctcctacagcggctccaccggttaccgcctctcctctgacacctccatctcaagcttctcctccatcacctccctccgcgacacgctccccgaaaacccccacatctacgacttctccgaaatctgtgccgccaccaacaacttcctctccaaacgccactcctcctccaccccttgctggcgctgcaccctccgtggcgccgacgtcattgtcttccagcgcaagtttcgcggcaaactccaaaccaaccagctccagcaactcctctccgtcgtctgccgcagccaccacgtcagcatcatcaaactccttggtgcctccgtctccggtgaccacatctaccttgtctacgacttcgtcagcaacggcgccaccctctccgactgcctccgcaacaaaaacaacgcgcacttcaccgttctctccacgtggatgtcgcgaatacaggtcgccacggatctcgctcacggcctcgattacattcacaacaaaaccggtttgaacatcaatttcgtccataaccatatcaagagcagcggaatcatcgtcaccgagccttccttcaatgctagggtttgccacttcggcgccgcgcagctctgcggcgaagtcgaactccagaaccagaaattaggcgaaattagtgaaatcgaggaaaaaataacatcatcgccggcgagatccaagaagttcgagggcgtgcgggggtacattgcgccagaatttccagcctccggcgttgcgactcagaagtctgatatatacgctttcggagtggtgatgttggagcttttgtccggggaagagccgttgaagttcaagtgtgacgagaaaacgcgcgaatttgtgaggatgtcggtgattgatgcggcgagggccgccgtggacggcgacgagggtagcgtggaggggaagctgaggaggtgggtggatcggagactgaaagattcttttcctgtcgacgttgctgagaagttgacacgtgtcgcgctggagtgcgtacacgtggatccagataagagaccgaacatgggacgcgtggctggaaagatctcaaagttttatttgacgtcgaggatctggtcagatagtattaagatgcctgatattactgttacgttgggacctcgatgatgttggcggctttattttttaattaaagtcaaatcgtggttttgatggtgattgtgacaccagttgtggaatatttatgttttcggaaagatgagctgaatttgtaggatgtccttttagtattgcgttcgattacttgcaatatcaaaggtggaataaataactagtgttggagtatatttcactgatcaaaaaaaaaaaaaaaa

SEQ ID NO: 5300 - protein, 424 aa, Glycine max
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 50915934; NR Description: protein kinase-like [Oryza sativa (japonica cultivar-group)] >gi|48716361|dbj|BAD22972.1| protein kinase-like [Oryza sativa (japonica cultivar-group)] >gi|48716496|dbj|BAD23101.1| protein
  misc_feature: GI Number: 57899494; NR Description: putative Nod-factor
  misc_feature: GI Number: 34909372; NR Description: putative receptor protein kinase tmk1 precursor [Oryza sativa (japonica cultivar-group)] >gi|14090351|dbj|BAB55510.1| putative receptor protein kinase tmk1 precursor [Oryza sativa (japonica
  misc_feature: GI Number: 42562696; NR Description: protein kinase family protein / peptidoglycan-binding LysM domain-containing protein
  misc_feature: GI Number: 50253149; NR Description: putative serine/threonine-specific protein kinase [Oryza sativa (japonica
MCKTKMATNAASPTRTPRSQQRPTQSPRTPSSRPTLRPTSFSNNPSTSYSGSTGYRLSSDTSISSFSSITSLRDTLPENPHIYDFSEICAATNNFLSKRHSSSTPCWRCTLRGADVIVFQRKFRGKLQTNQLQQLLSVVCRSHHVSIIKLLGASVSGDHIYLVYDFVSNGATLSDCLRNKNNAHFTVLSTWMSRIQVATDLAHGLDYIHNKTGLNINFVHNHIKSSGIIVTEPSFNARVCHFGAAQLCGEVELQNQKLGEISEIEEKITSSPARSKKFEGVRGYIAPEFPASGVATQKSDIYAFGVVMLELLSGEEPLKFKCDEKTREFVRMSVIDAARAAVDGDEGSVEGKLRRWVDRRLKDSFPVDVAEKLTRVALECVHVDPDKRPNMGRVAGKISKFYLTSRIWSDSIKMPDITVTLGPR

SEQ ID NO: 5301 - DNA, 1502 bp, Glycine max
  misc_feature (1)..(1502): Ceres cDNA ID no. 22005713
  misc_feature (1)..(1502): Ceres CLONE  ID no. 1045659
  misc_feature (1)..(1502): Also known as  Ceres CDNA ID no. 24403217
tcaaaatcacattttgtctctctccatttcttgtgttgtatatatcatccaatgaagagagatcaaattgcgatgtgttaggagaatagctgtatgagtataaatatgaagacgtagaaagtatggtcttgaatattattttactaaacctcttctcatcaatctatctatctcatgtggacaagcgagtgctccatgttccgcaggctcctctgcacctctcttccccgtctttcaaaaccccaatcttcaagctccttaaccattctcaactcctcactcacccaaaaacaaaaacaaaagcccttatctccccaaaccatcaaatccttctcctcttccaaaatgggggacgcgcgaagacccttattcgtcccaatccccactttggaaaaagcagaacgctccgacctcctccgcgccctagaagcttccatgggctcccctttcagctccgagcctctctctccaaaccctaaccctctaatcatcgtcatcagcggccccagcggcgtcggcaaggacaccctcatcgcgcgcctccgcgactcccgccgcgccctccacttcgttgtcaccgccaccacgcgcccccgccgccccgccgaggtcgacgggaaggactacatcttcgtctccaaggaggagtttctcgggatggtggagcgggaggagctgctggagtacgcgctggtctacggtgactacaagggcgtgccgaagcagcagattcgggagtgtctcgcgcaaggctgcgacgtcgttttgagggttgatattcagggggctgccacgttgaagaaggcgctcgggaagtcggcggtgtttgtatttgtggcggcggagagcgagatggcgttggtggagaggctggtggaccggaagacggagaccgtggagtcgttgctggtgaggattggtactgccagggaggagatgaagcatgtcaagaattttgattatgttgtggtcaatgcgaaagggaagcttgataatgcggtcaagttgatggagtctattattgatgccgagaaagctagggtttctcagaggactcctcacttataatggacgctcaacatggttttatgatggatgataaactggggatgatcgtaaaaatattatttgtgagctctgcttgccagtgacgagcttgatgctcatttcctacgactgatgtcatcatgggaagacatgttgggggtaatggttctagtggtgattcttccaatactgccttaaatgaagtacaagtgtttgttcttggtgaatagaaattttaattacaatgccaaatatcatttgtttattttattcggtgatctggttggaaatagttatgtaggaagcaaattgaatttagtggatgaaacagtgaactgaactgacacagatagctttgatacctcgtgtaatccttcttatgaactgattcaaaaagccagtggctcaaacttaatcccaataggtttttatgcattacaaaaaaaaaaaaaaaa

SEQ ID NO: 5302 - protein, 1502 aa, Glycine max
  misc_feature: PFam Name: Guanylate_kin; PFam Description: Guanylate kinase
  misc_feature: PFam Name: Extensin_2; PFam Description: Extensin-like region
  misc_feature: PFam Name: Pyr_redox_2; PFam Description: Pyridine
  misc_feature: GI Number: 17386098; NR Description: AT3g06200/F28L1_14 [Arabidopsis thaliana] >gi|14190399|gb|AAK55680.1| AT3g06200/F28L1_14 [Arabidopsis thaliana] >gi|18397500|ref|NP_566276.1| guanylate kinase, putative
  misc_feature: GI Number: 6862924; NR Description: putative guanylate kinase
  misc_feature: GI Number: 53798008; NR Description: COG0194: Guanylate
  misc_feature: GI Number: 57233615; NR Description: guanylate kinase [Dehalococcoides ethenogenes 195] gi|57224063|gb|AAW39120.1|
  misc_feature: GI Number: 28210904; NR Description: guanylate kinase [Clostridium tetani E88] >gi|32171437|sp|Q895Q5|KGUA_CLOTE Guanylate kinase (GMP kinase) >gi|28203343|gb|AAO35785.1| guanylate
TCAAAATCACATTTTGTCTCTCTCCATTTCTTGTGTTGTATATATCATCCAATGAAGAGAGATCAAATTGCGATGTGTTAGGAGAATAGCTGTATGAGTATAAATATGAAGACGTAGAAAGTATGGTCTTGAATATTATTTTACTAAACCTCTTCTCATCAATCTATCTATCTCATGTGGACAAGCGAGTGCTCCATGTTCCGCAGGCTCCTCTGCACCTCTCTTCCCCGTCTTTCAAAACCCCAATCTTCAAGCTCCTTAACCATTCTCAACTCCTCACTCACCCAAAAACAAAAACAAAAGCCCTTATCTCCCCAAACCATCAAATCCTTCTCCTCTTCCAAAATGGGGGACGCGCGAAGACCCTTATTCGTCCCAATCCCCACTTTGGAAAAAGCAGAACGCTCCGACCTCCTCCGCGCCCTAGAAGCTTCCATGGGCTCCCCTTTCAGCTCCGAGCCTCTCTCTCCAAACCCTAACCCTCTAATCATCGTCATCAGCGGCCCCAGCGGCGTCGGCAAGGACACCCTCATCGCGCGCCTCCGCGACTCCCGCCGCGCCCTCCACTTCGTTGTCACCGCCACCACGCGCCCCCGCCGCCCCGCCGAGGTCGACGGGAAGGACTACATCTTCGTCTCCAAGGAGGAGTTTCTCGGGATGGTGGAGCGGGAGGAGCTGCTGGAGTACGCGCTGGTCTACGGTGACTACAAGGGCGTGCCGAAGCAGCAGATTCGGGAGTGTCTCGCGCAAGGCTGCGACGTCGTTTTGAGGGTTGATATTCAGGGGGCTGCCACGTTGAAGAAGGCGCTCGGGAAGTCGGCGGTGTTTGTATTTGTGGCGGCGGAGAGCGAGATGGCGTTGGTGGAGAGGCTGGTGGACCGGAAGACGGAGACCGTGGAGTCGTTGCTGGTGAGGATTGGTACTGCCAGGGAGGAGATGAAGCATGTCAAGAATTTTGATTATGTTGTGGTCAATGCGAAAGGGAAGCTTGATAATGCGGTCAAGTTGATGGAGTCTATTATTGATGCCGAGAAAGCTAGGGTTTCTCAGAGGACTCCTCACTTATAATGGACGCTCAACATGGTTTTATGATGGATGATAAACTGGGGATGATCGTAAAAATATTATTTGTGAGCTCTGCTTGCCAGTGACGAGCTTGATGCTCATTTCCTACGACTGATGTCATCATGGGAAGACATGTTGGGGGTAATGGTTCTAGTGGTGATTCTTCCAATACTGCCTTAAATGAAGTACAAGTGTTTGTTCTTGGTGAATAGAAATTTTAATTACAATGCCAAATATCATTTGTTTATTTTATTCGGTGATCTGGTTGGAAATAGTTATGTAGGAAGCAAATTGAATTTAGTGGATGAAACAGTGAACTGAACTGACACAGATAGCTTTGATACCTCGTGTAATCCTTCTTATGAACTGATTCAAAAAGCCAGTGGCTCAAACTTAATCCCAATAGGTTTTTATGCATTACAAAAAAAAAAAAAAAA

SEQ ID NO: 5303 - DNA, 1374 bp, Glycine max
  misc_feature (1)..(1374): Ceres cDNA ID no. 22005714
  misc_feature (1)..(1374): Ceres CLONE  ID no. 1046786
  misc_feature (1)..(1374): Also known as  Ceres CDNA ID no. 25892360
cactttctttgttgtgtagaaaacgaaaaggagaagatgaaatgggatatgcagatggaggaaatcgaagcgattatggagaaaatttgggacctccacgataagctcagcgacgccattcactccgtctccagatcccactttctcacttccgtcaaaaccctcaaactcaacaactctccaccgcaccttcccaacgccgccgtcgccgctgccgatgaccgctcctccggtttcgttttcgtcaaggactttagaccgctcgccgtcgccgataacgacaacgatgacgatgactccgccgtccgcgaagccaagagcctcaacgccatccggaccgccctcgagaacctcgaagaccagctcgagttcttccatactattcaaacccagcagcgtgttgagagagatgccgcaattgcacgcttagaacagagcagaattgttcttgcaatgaggctggcagaacaccgtggtaaaaagtataaagtcattgaagaagctcttgcttttattggagatgtacatgatgcaggcagccttgttgcgcctgatgttttctatggacaaccaaactgttgttctgctgagaatttagcgactgagaaagtgaagagatctaatattcttatcaatatttttgtctcaagtttcaattttgtgaagagatctcttggattggatcatatgggtggaatagtgggcaatgctgcattggttgcagttagcatgatagctttgcttcatttacatcaggtaactaatcatgagcagccatttggacaagaaaatactgttcacagaaacagtaccgtgagaagaacgagattggttggttcttcatccgaagcccattccagtaatttggatgtattgttagctagaggttaggattaaacctctatcccataatgaaatgatgagtgggttatgttttcagtgtgttctttttttctccttttttgtgctcttggtcctttttttttcctcggttacaaagaaggcatgaaacctggtgttgtgaagggaggataggctaaatcagaggcaaagcttggtgtcacttgtgctaaggctcttgagctcgtcttcttggtttttttgccaccaaaaattttgaaagtggcattatagttgatctgaaaaggtgcaagatgtaggttgtgtttgctggattccttattgaggtgcagatgcttgaagttttagagttagttgaaaattaacacaaatgtttcttctttctctgctaggtagtgtcatctgtggtagattcctgcgcaatttttgtcaacttttgttgatggaatgtgaatgtcttgtaccttcatttttcttgttacaatttaggctaaaataaaaaaaaaaaaaaaa

SEQ ID NO: 5304 - protein, 284 aa, Glycine max
MKWDMQMEEIEAIMEKIWDLHDKLSDAIHSVSRSHFLTSVKTLKLNNSPPHLPNAAVAAADDRSSGFVFVKDFRPLAVADNDNDDDDSAVREAKSLNAIRTALENLEDQLEFFHTIQTQQRVERDAAIARLEQSRIVLAMRLAEHRGKKYKVIEEALAFIGDVHDAGSLVAPDVFYGQPNCCSAENLATEKVKRSNILINIFVSSFNFVKRSLGLDHMGGIVGNAALVAVSMIALLHLHQVTNHEQPFGQENTVHRNSTVRRTRLVGSSSEAHSSNLDVLLARG

SEQ ID NO: 5305 - DNA, 995 bp, Triticum aestivum
  misc_feature (1)..(995): Ceres cDNA ID no. 22005715
  misc_feature (1)..(995): Ceres CLONE  ID no. 1047295
  misc_feature (1)..(995): Also known as  Ceres CDNA ID no. 24412733
accgcaatacaccactcaccccctcacgctctcgctcatcacccccccaacaactaactccaccaccacagtatcaatcagccatgggcgccacggaggattcctcctccggctccgagaccaccacctcgtcctcggtggaggccctggcctcgccgccgtccccgacggccaccaccgcgtcgtcgaagaagaagcggccgcgcaacgacgggcggcacccgacgtaccgcggggtgcgcatgcggagctggggcaagtgggtgtcggagattcgggagccccgcaagaagtcgcgcatctggctcggcaccttcgccaccgcggagatggcggcgcgcgcgcacgacgtggccgccctcgccatcaagggccgtgccgcgcacctcaacttccccgacctcgcccacgagctcccgcgcccggccaccgccgcgcccaaagacgtccaggcggccgccgcactcgccgcctccgccgacttcccggcctctgccactgcagctgccaatgccggcgccaagaaccccgacggcccggaacacagcggcgcctccgcctctgcctccgcctctgcctctgcctctgcctcgccgccgcctgacaccgctgaggatgcgctgttcgacctccccgacctcctcttcgacctcagacacggccctccgtcctgccagctttcgtgcgcctcctcgtgggacgacgacgtggccttcgccggccctggcgccggcgtgttccgcctggaggagccgctgcagtgggagtactaaagccaggcgccaactcgctcagtcaccggtgccatcaaaccgcgccgccgctgcatgcatgtatggctcgttcgtttccacatcgggccggaaatcatttcgaaaccattggagaaccaaaagaaggaagcaaaaccactggagtactactaaatttaggagtgagaccatgtacaaattggggttagccttgtgttctttatcataaaaaaaaaaaaaaaa

SEQ ID NO: 5306 - protein, 229 aa, Triticum aestivum
  misc_feature: PFam Name: AP2; PFam Description: AP2 domain
  misc_feature: PFam Name: Pyr_redox_2; PFam Description: Pyridine
  misc_feature: PFam Name: Extensin_2; PFam Description: Extensin-like region
  misc_feature: PFam Name: FH2; PFam Description: Formin Homology 2 Domain
  misc_feature: PFam Name: GATase_2; PFam Description: Glutamine
  misc_feature: GI Number: 21908034; NR Description: DRE binding factor 2
  misc_feature: GI Number: 25990951; NR Description: DREB-like protein [Zea mays]
  misc_feature: GI Number: 37536842; NR Description: putative DNA binding protein [Oryza sativa (japonica cultivar-group)] >gi|18873847|gb|AAL79793.1| putative DNA binding protein [Oryza sativa] >gi|31433505|gb|AAP55010.1| putative DNA binding protein
  misc_feature: GI Number: 53792665; NR Description: putative Ap21 [Oryza
  misc_feature: GI Number: 30794084; NR Description: putative AP2 domain transcription factor [Arabidopsis thaliana] >gi|30793877|gb|AAP40391.1| putative AP2 domain transcription factor [Arabidopsis thaliana] >gi|20196923|gb|AAM14835.1|
MGATEDSSSGSETTTSSSVEALASPPSPTATTASSKKKRPRNDGRHPTYRGVRMRSWGKWVSEIREPRKKSRIWLGTFATAEMAARAHDVAALAIKGRAAHLNFPDLAHELPRPATAAPKDVQAAAALAASADFPASATAAANAGAKNPDGPEHSGASASASASASASASPPPDTAEDALFDLPDLLFDLRHGPPSCQLSCASSWDDDVAFAGPGAGVFRLEEPLQWEY

SEQ ID NO: 5307 - DNA, 989 bp, Triticum aestivum
  misc_feature (1)..(989): Ceres cDNA ID no. 22005716
  misc_feature (1)..(989): Ceres CLONE  ID no. 1047435
  misc_feature (1)..(989): Also known as  Ceres CDNA ID no. 24412623
agtcgtctcccctgtccccctcgtcctcctcccgcaatccaatcacggggacgggtgagcagcgagcgagcgagcgggatggcgacgctgacctcggagctgctgcggccggtgcacgcggcgcaggcgctggacgaggcggcgctgctgcgctacgcggccgcgcacgtcccgggcttccccacgcccgcgccggcgctcgccctcacgcagttcggccacggccagtccaaccccacctactgcatccaggcctccgcgcccggcggggagcccaggcgctacgtgctgcggaagaagcccgccggcgccatcctccagtccgcccacgccgtcgagcgcgagttccaggttctcaaagctttgggtgcctacacggatgttcctgtccctaaggtgttttgcctttgcactgatgccagtgtgatcggaaccccattctacataatggagtatctggaaggagcattatatcttaataacaagttaacgggagtaaccccagagaaacggaggaatatatacttggctgctgcaaaaactttggctgctgtacacaaaattgatacgactgcagttggattgcataagtatggaagaagagacaattattgcaaaagacaagtagaaagatggggaaaacaatatcttcattcaaccggtgaagggaagcctgcacgttatcagaagatgcttgatctgattggttggctgaaagaaaatataccagaagaagattcatcgacaggattgggaactggccttgttcatggtgattatcgtgttgataaccttgtttttcacccaactgaggatcgagtgataggtgtacttgattgggaattatctactttggggaatcagatgtgtgatgttgcttacagctgtatggtatgaaatatgaaactgtattagggaaaatgtgaaataccttcttatacataatattgttggaaattattcacctatttacaaaaaaaaaaaaaaaa

SEQ ID NO: 5308 - protein, 272 aa, Triticum aestivum
  misc_feature: PFam Name: APH; PFam Description: Phosphotransferase enzyme family
  misc_feature: GI Number: 50939937; NR Description: putative acyl-CoA dehydrogenase [Oryza sativa (japonica cultivar-group)] >gi|34393862|dbj|BAC83542.1| putative acyl-CoA dehydrogenase [Oryza sativa (japonica cultivar-group)]
  misc_feature: GI Number: 48849534; NR Description: COG3173: Predicted aminoglycoside phosphotransferase [Novosphingobium aromaticivorans
  misc_feature: GI Number: 46131783; NR Description: COG3173: Predicted
  misc_feature: GI Number: 53760886; NR Description: COG3173: Predicted
  misc_feature: GI Number: 46324588; NR Description: COG3173: Predicted
MATLTSELLRPVHAAQALDEAALLRYAAAHVPGFPTPAPALALTQFGHGQSNPTYCIQASAPGGEPRRYVLRKKPAGAILQSAHAVEREFQVLKALGAYTDVPVPKVFCLCTDASVIGTPFYIMEYLEGALYLNNKLTGVTPEKRRNIYLAAAKTLAAVHKIDTTAVGLHKYGRRDNYCKRQVERWGKQYLHSTGEGKPARYQKMLDLIGWLKENIPEEDSSTGLGTGLVHGDYRVDNLVFHPTEDRVIGVLDWELSTLGNQMCDVAYSCMV

SEQ ID NO: 5309 - DNA, 605 bp, Zea mays
  misc_feature (1)..(605): Ceres cDNA ID no. 22005717
  misc_feature (1)..(605): Ceres CLONE  ID no. 1060847
  misc_feature (1)..(605): Also known as  Ceres CDNA ID no. 23827451
gaaaaaggaaaggaaaatggcaggaagactgagcggtgtggcctcacgaatcatggggggaaacggcgtcgttgcccgatctggcgcctcttctctgcgccaacgcgccggcatgggtctccccgtcggcaaacacatcgtccccgacaagccgctttcggttaacgacgagctgatgtgggacaacgggactgcgttcccagagccttgcattgatcgaatcgctgatactgttgggaagtatgaagcattgggatggttgtgtggcggtctagggttctttgcgactctaggtctcctcgctgttgtcaacgataaagcttcaaaggttccctttacaccacgagtgtatccgtatgacaacctgagagtggagcttggaggagagccatagagacacgatcaagtgatctgctcatcaaaactctaagcgtgttttcttcactgctttcttcttcaaaatcttttcatttcctgctcacaacttggtgacaaaagaataaatagacccttttcattgtctgttgtctctgtaattaacagtgaccttttgggtgtattcataagagaagacatgtacttttcagtcaaaaaaaaaaaaaaaa

SEQ ID NO: 5310 - protein, 605 aa, Zea mays
GAAAAAGGAAAGGAAAATGGCAGGAAGACTGAGCGGTGTGGCCTCACGAATCATGGGGGGAAACGGCGTCGTTGCCCGATCTGGCGCCTCTTCTCTGCGCCAACGCGCCGGCATGGGTCTCCCCGTCGGCAAACACATCGTCCCCGACAAGCCGCTTTCGGTTAACGACGAGCTGATGTGGGACAACGGGACTGCGTTCCCAGAGCCTTGCATTGATCGAATCGCTGATACTGTTGGGAAGTATGAAGCATTGGGATGGTTGTGTGGCGGTCTAGGGTTCTTTGCGACTCTAGGTCTCCTCGCTGTTGTCAACGATAAAGCTTCAAAGGTTCCCTTTACACCACGAGTGTATCCGTATGACAACCTGAGAGTGGAGCTTGGAGGAGAGCCATAGAGACACGATCAAGTGATCTGCTCATCAAAACTCTAAGCGTGTTTTCTTCACTGCTTTCTTCTTCAAAATCTTTTCATTTCCTGCTCACAACTTGGTGACAAAAGAATAAATAGACCCTTTTCATTGTCTGTTGTCTCTGTAATTAACAGTGACCTTTTGGGTGTATTCATAAGAGAAGACATGTACTTTTCAGTCAAAAAAAAAAAAAAAA

SEQ ID NO: 5311 - DNA, 1158 bp, Zea mays
  misc_feature (1)..(1158): Ceres cDNA ID no. 22005718
  misc_feature (1)..(1158): Ceres CLONE  ID no. 1061027
  misc_feature (1)..(1158): Also known as  Ceres CDNA ID no. 23827521
ataagcatttcacgcttcaccaatggcttctctcatgctcaacggggccatcaccttccccaagggattaggcttccccgcttccaatctacacgccagaccaagtcctccgctgagtctcgtctcaaacacagccacgcggagactctccgtggcgacaagatgcagcagcagcagcagcgtgtcggcgtcaaggccatctgcgcagcctaggttcatccagcacaagaaagaggcctactggttctacaggttcctgtccatcgtgtacgaccacatcatcaatcccggccactggacggaggatatgagggacgacgctctcgagcctgcggatctgagccatccggacatgcgagttgtcgacgtcggaggcggaacgggtttcaccacgctgggaatcgtcaagacggtgaaggctaagaacgtgacgattctggaccagtcgccgcatcagctggcaaaggcgaagcagaaggagccgttgaaggagtgcaagatcgtggaaggagatgcggaggatctcccttttcctactgattatgctgacagatacgtctctgctggaagcattgagtactggcccgacccgcagaggggtataagggaagcgtacagagttctcaagatcggtgggaaagcatgtctcattggccctgtccacccgacgttttggctttcacgcttctttgcagatgtgtggatgcttttccccaaggaggaggagtacattgagtggttcaagaatgctggtttcaaggacgttcagcttaagaggattggccccaagtggtaccgtggtgttcgcaggcacggacttatcatgggatgctctgttactggtgtcaaacctgcctctggagactctcctctccagcttggaccaaaggaagaggacgtggagaagcctgtaaacaatcctttctccttcttgggacgcttcctcttgggtaccctagcggctgcctggtttgtgttaatcccaatctacatgtggatcaaggatcagatcgttcccaaagaccaacccatctgataacaacttgtgatttgtaatacactcctatgttagacgcttttttttttgtcctcgtgactatgttgagcccttttcaaaaatatatctatcactctattccaccaaaaaaaaaaaaaaaa

SEQ ID NO: 5312 - protein, 337 aa, Zea mays
  misc_feature: PFam Name: Ubie_methyltran; PFam Description: ubiE/COQ5
  misc_feature: PFam Name: MTS; PFam Description: Methyltransferase small domain
  misc_feature: PFam Name: TPMT; PFam Description: Thiopurine
  misc_feature: PFam Name: UPF0020; PFam Description: Putative RNA methylase
  misc_feature: PFam Name: Methyltransf_4; PFam Description: Putative
  misc_feature: GI Number: 21228; NR Description: 37 kD inner envelope membrane polypeptide [Spinacia oleracea] >gi|124429|sp|P23525|IN37_SPIOL 37 kDa inner envelope membrane
  misc_feature: GI Number: 1419090; NR Description: 37kDa chloroplast inner envelope membrane polypeptide precursor [Nicotiana tabacum] >gi|7489166|pir||T03230 membrane protein, 37K, precursor,
  misc_feature: GI Number: 15005009; NR Description: APG1 [Arabidopsis thaliana]
  misc_feature: GI Number: 50934645; NR Description: putative 37kDa chloroplast inner envelope membrane polypeptide precursor [Oryza sativa (japonica cultivar-group)] >gi|34393472|dbj|BAC83032.1| putative 37kDa chloroplast inner envelope membrane polypeptide
  misc_feature: GI Number: 21553996; NR Description: putative chloroplast
MASLMLNGAITFPKGLGFPASNLHARPSPPLSLVSNTATRRLSVATRCSSSSSVSASRPSAQPRFIQHKKEAYWFYRFLSIVYDHIINPGHWTEDMRDDALEPADLSHPDMRVVDVGGGTGFTTLGIVKTVKAKNVTILDQSPHQLAKAKQKEPLKECKIVEGDAEDLPFPTDYADRYVSAGSIEYWPDPQRGIREAYRVLKIGGKACLIGPVHPTFWLSRFFADVWMLFPKEEEYIEWFKNAGFKDVQLKRIGPKWYRGVRRHGLIMGCSVTGVKPASGDSPLQLGPKEEDVEKPVNNPFSFLGRFLLGTLAAAWFVLIPIYMWIKDQIVPKDQPI

SEQ ID NO: 5313 - DNA, 896 bp, Zea mays
  misc_feature (1)..(896): Ceres cDNA ID no. 22005719
  misc_feature (1)..(896): Ceres CLONE  ID no. 1061135
  misc_feature (1)..(896): Also known as  Ceres CDNA ID no. 23828272
aataccaacggtttcattcatatctgactcagtgttcctgattctccagcgaccaagacaagactatcttcgcagtccaggagatgttaggaagctccttagcttcccctttggctacattgggtcctgccaattgctttcgacactctgcaggtgattctctaacatgcactagtgttctaccattgagcctgaacttgtcatatcatggtgtggctggaggagtaaggacatctcgtggtccacgaaacaagtggatagtggtctgttcaccaacgcaagtggaaacctctggtgatgagccaaagacatgggaagaatgcaaagaagctctgtctcgttttgatttcagcgtagaggagcaagacaagatactaggaaaagcgtttggtcatatccactcgccctactggacagaagaacgagtgaaagagaatccaaaggtggaagctttgaatcacgtacttgagttccttagaagtctcggtttgtcagacgaggatcttcacaaagtgctgaagaagttcccggaagtactcggttgcagcttagaagaagagatgaaacccaacattgggatcttggaaaatcaatgggggattacgggtaagtcgctgcgaagtctgttgctccggaacccgaaagtgttggggtacaatgtggattgtaaaggagattgtattgctcagtgcactcggtgttgggttcggttttagtctttctttccctagttcgtttgtttgtctctagtctctccatcttatggtttcattacagctactgaaataaactagcctcgatggttgaaggaccaatgtgaatgcttgtactttagatgaatcacacattaatttttatttgatgaattagaatgtttattaaaaaaaaaaaaaaaa

SEQ ID NO: 5314 - protein, 210 aa, Zea mays
  misc_feature: PFam Name: mTERF; PFam Description: mTERF
MLGSSLASPLATLGPANCFRHSAGDSLTCTSVLPLSLNLSYHGVAGGVRTSRGPRNKWIVVCSPTQVETSGDEPKTWEECKEALSRFDFSVEEQDKILGKAFGHIHSPYWTEERVKENPKVEALNHVLEFLRSLGLSDEDLHKVLKKFPEVLGCSLEEEMKPNIGILENQWGITGKSLRSLLLRNPKVLGYNVDCKGDCIAQCTRCWVRF

SEQ ID NO: 5315 - DNA, 1128 bp, Zea mays
  misc_feature (1)..(1128): Ceres cDNA ID no. 22005721
  misc_feature (1)..(1128): Ceres CLONE  ID no. 1061698
  misc_feature (1)..(1128): Also known as  Ceres CDNA ID no. 23828285
aaaaacaaaaaaaactagaactatctgagagacactctgtggccatggcagcttctctccaatccgccgccacattcctccactccgcaaaaatctccaccgctccttctcgcggcagtgctcacctccgttcgactcagaccgtcggcaaatcattcggcctagagacttcttctgcacgcctcacttgttcctaccaatctgatatcaaggacttcgccggaaaatgctccgacgctgttaaaatcgccggattcgctcttgcaacctctgctctcgtcgtctcgggagcaagtgcagagggtgctccgaagagactcacatatgacgagatacagagcaagacatacatggaagtcaaaggaaccggaactgccaaccagtgtccaactattgacggtggctctgagactttctccttcaaacccggtaagtacgctggcaagaagttctgcttcgagcctacttccttcaccgtcaaagccgagagtgttagcaagaacgcacctcctgagtttcagaacaccaagctcatgacccgtctcacctacacccttgacgaaatcgaaggccccttcgaggtttcttcagacggaagcgtgaacttcaaggaagaagacggaatcgactacgctgcagtcactgttcagcttccaggaggcgagcgtgtgccgttcctcttcacagtcaagcagcttgacgcctcgggcaaaccagacaacttcactggcaaattcttggtcccgtcgtaccgtggctcgtccttcttggacccaaagggtcgtggtggatccacaggatatgacaacgccgttgcattgccagctggaggcagaggagacgaagaggagctttcgaaggagaacgtgaagaacacggcagcttcggtgggagagatcactctgaaagtgaccaagagcaaaccggagacaggagaagtgatcggagtgttcgagagtcttcagccgtctgatactgacttgggtgccaaggtaccaaaggatgtgaagatccaaggggtgtggtatggacaacttgagtgatcatgttattatatcaaaacattttcttctgttcattgtatttgatgataatgagaacatcttttcatgaaaaaaaaaaaaaaaa

SEQ ID NO: 5316 - protein, 332 aa, Zea mays
  misc_feature: PFam Name: MSP; PFam Description: Manganese-stabilising
  misc_feature: GI Number: 22571; NR Description: 33 kDa oxygen-evolving protein [Arabidopsis thaliana] >gi|99745|pir||S11852 photosystem II
  misc_feature: GI Number: 21593220; NR Description: 33 kDa polypeptide of oxygen-evolving complex (OEC) in photosystem II [Arabidopsis
  misc_feature: GI Number: 23198398; NR Description: 33 kDa polypeptide of oxygen-evolving complex (OEC) in photosystem II [Arabidopsis thaliana] >gi|22530906|gb|AAM96957.1| 33 kDa polypeptide of oxygen-evolving complex (OEC) in photosystem II [Arabidopsis
  misc_feature: GI Number: 15451006; NR Description: 33 kDa polypeptide of
  misc_feature: GI Number: 10177538; NR Description: 33 kDa polypeptide of oxygen-evolving complex [Arabidopsis thaliana] gi|3286693|emb|CAA75629.1| 33 kDa polypeptide of oxygen-evolving complex (OEC) in photosystem II [Arabidopsis thaliana]
MAASLQSAATFLHSAKISTAPSRGSAHLRSTQTVGKSFGLETSSARLTCSYQSDIKDFAGKCSDAVKIAGFALATSALVVSGASAEGAPKRLTYDEIQSKTYMEVKGTGTANQCPTIDGGSETFSFKPGKYAGKKFCFEPTSFTVKAESVSKNAPPEFQNTKLMTRLTYTLDEIEGPFEVSSDGSVNFKEEDGIDYAAVTVQLPGGERVPFLFTVKQLDASGKPDNFTGKFLVPSYRGSSFLDPKGRGGSTGYDNAVALPAGGRGDEEELSKENVKNTAASVGEITLKVTKSKPETGEVIGVFESLQPSDTDLGAKVPKDVKIQGVWYGQLE

SEQ ID NO: 5317 - DNA, 1296 bp, Zea mays
  misc_feature (1)..(1296): Ceres cDNA ID no. 22005722
  misc_feature (1)..(1296): Ceres CLONE  ID no. 1062172
  misc_feature (1)..(1296): Also known as  Ceres CDNA ID no. 23826926
agcctgcgctcacttgagcacactgcacttttctgctcgcgacgccgcgtgcggacagtcagtctgtttccatctcccatggccgccatggccagcaacacttccggccctgttccgttcacggacgtcgacgacggcacggtgccgaagcgcccagccaaggaggagttcggcggcctcgtcgcagcgctgccgcggaagcatcaggccggcctggagctgcgcctgtaccagggcttctggctgcccgaccactgggtcgccggcaccgtcgtcttccagcggcgcttcgccccacgccccgacgacgtgatcctggccagctaccccaagtgcggcaccacgtggctcaaggcgctggccttcgccaccatgacgcgcgacgcgtacccggcgccggcgcagcacccgctcctccgcctcaacccgcacgactgcatcccgttcctggacgagatctttgccgacgggcaggaggccaagctggagaagctcccgtcgccgcgcctcatgaacacgcacatgccgcacaccttgctccccgagtcggtcaccggcgccgccgtcgccggctgcaaggtcgtgtacatctgcagggaccccaaggacatggtcgtgtcgctgtggcacttcctccggcgccggcagccggagctcccgttcgcggagctgttcgagcacgtgtgcgacggcgccgtggccgtcggcccgatctgggaccacgtgctcagctactggcgcgcgagcctcgcgcggcccgacagggtgctcttcctcaggtacgaggagctgctgcaggacacgggcaagcacgtgaggaagctggcggagttcatgggccggcctttctcgcctgccgaggagggcgccggcgccgtggaaggcgtggtggagctgtgcagcttcgagaagatgaaggggctggaggtgaacaagaaaggctcggcgggggcgtaccacgccatgccccgcgactctttcttcaggaaaggggtcgccggcgactgggtgaaccacatgacgccggagatggcgacgcggctggatgaggttgtccgtgacaagttccgcggcacggcgctcgcggctccatgatcgggacacgtcgcgtgcgtgtgggtaaattaagcgaggcaatcagcatgcgtgattcgcttgtactgtatgcttggctgctggtacctgtcgatttaaaataagagatgctgttctcggcacaaccactacctacattatggtataaatatttaactatgattatctattgcaacattttggccaaaaaaaaaaaaaaaa

SEQ ID NO: 5318 - protein, 338 aa, Zea mays
  misc_feature: PFam Name: Sulfotransfer_1; PFam Description:
  misc_feature: GI Number: 50508649; NR Description: putative STF-1 [Oryza
  misc_feature: GI Number: 50934205; NR Description: putative flavonol 3-sulfotransferase [Oryza sativa (japonica cultivar-group)] >gi|34393650|dbj|BAC83346.1| putative flavonol 3-sulfotransferase
  misc_feature: GI Number: 50942729; NR Description: putative flavonol 3-sulfotransferase [Oryza sativa (japonica cultivar-group)] >gi|40253317|dbj|BAD05251.1| putative flavonol 3-sulfotransferase
  misc_feature: GI Number: 50942733; NR Description: putative flavonol 3-sulfotransferase [Oryza sativa (japonica cultivar-group)] >gi|40253319|dbj|BAD05253.1| putative flavonol 3-sulfotransferase
  misc_feature: GI Number: 50943387; NR Description: putative flavonol 3-sulfotransferase [Oryza sativa (japonica cultivar-group)] >gi|37805891|dbj|BAC99740.1| putative flavonol 3-sulfotransferase
MAAMASNTSGPVPFTDVDDGTVPKRPAKEEFGGLVAALPRKHQAGLELRLYQGFWLPDHWVAGTVVFQRRFAPRPDDVILASYPKCGTTWLKALAFATMTRDAYPAPAQHPLLRLNPHDCIPFLDEIFADGQEAKLEKLPSPRLMNTHMPHTLLPESVTGAAVAGCKVVYICRDPKDMVVSLWHFLRRRQPELPFAELFEHVCDGAVAVGPIWDHVLSYWRASLARPDRVLFLRYEELLQDTGKHVRKLAEFMGRPFSPAEEGAGAVEGVVELCSFEKMKGLEVNKKGSAGAYHAMPRDSFFRKGVAGDWVNHMTPEMATRLDEVVRDKFRGTALAAP

SEQ ID NO: 5319 - DNA, 1190 bp, Zea mays
  misc_feature (1)..(1190): Ceres cDNA ID no. 22005723
  misc_feature (1)..(1190): Ceres CLONE  ID no. 1062236
  misc_feature (1)..(1190): Also known as  Ceres CDNA ID no. 23827168
aagattagtcactcttcgcaagccaaaaaaaaaaaccccaaattgcggaaggataagcctcgccggcgacgaaatcagggtttcatcgaacaagaagatggctcacgcttgcgtctacacatcggcttcttcactcaggtttacagccggattcgtctccgcgagtcccaacgcctcctctttcgattctcagaagctttccctccctttcgagcctcttcgttcaagaaagacgaagaagttagttagcgtcagaaagaattggaagagctcgtctccgaaggctgtgtactccggcaatctctggacgccggagactccttcgcctcaaggagtttggtccatcagagatgatttacaagtcccttcttcgccgtattttcctgcgtacgctcaaggacaaggaccacctcctatggtgcaagagcgtttccagagtatcataagccagctcttccaatataggattattcgttgtggtggtgctgtggacgatgatatggccaacataatcgtagctcagcttctttaccttgatgctgttgatcctactaaggatattgtcatgtatgtgaactctcctggtggatcagttacagctggcatggctatattcgatactatgaggcatatccgacctgatgtctccactgtctgtgtcggtctagctgctagtatgggagcctttctgcttagtgctggaaccaaagggaaaagatacagtctgccaaactcaaggataatgatccatcagccgcttggtggagctcaaggtggccaaaccgatatcgacattcaggcaaatgaaatgctgcatcacaaggcaaacctaaacggttacctcgcttaccagactggtcaaagcctagagaagataaaccaggacacagaccgtgatttcttcatgagtgctaaagaagcaaaagattacgggcttatcgatggtgttatcatgaaccctcttaaggcccttcagccacttgcagcagcttgatcgcctgaaggtaatgtttcagcttgtcacttacattttggtgggccttttctgaacttagaatgaaaacaaatcagtagctgatacatacatgaacaagtaaagttttctttctctgctgtttgattgaataacaatgacattgtaatgttttgatcctttgtaatcgaattattggccaaaaaaaaaaaaaaaa

SEQ ID NO: 5320 - protein, 298 aa, Zea mays
  misc_feature: PFam Name: CLP_protease; PFam Description: Clp protease
  misc_feature: GI Number: 15485610; NR Description: Clp protease 2
  misc_feature: GI Number: 63003513; NR Description: ATP-dependent protease
  misc_feature: GI Number: 23126705; NR Description: COG0740: Protease subunit of ATP-dependent Clp proteases [Nostoc punctiforme PCC
  misc_feature: GI Number: 53764293; NR Description: COG0740: Protease subunit of ATP-dependent Clp proteases [Anabaena variabilis ATCC
  misc_feature: GI Number: 17228733; NR Description: ATP-dependent Clp protease proteolytic subunit [Nostoc sp. PCC 7120] >gi|21759071|sp|Q8YXH5|CLP1_ANASP ATP-dependent Clp protease proteolytic subunit 1 (Endopeptidase Clp 1)
MAHACVYTSASSLRFTAGFVSASPNASSFDSQKLSLPFEPLRSRKTKKLVSVRKNWKSSSPKAVYSGNLWTPETPSPQGVWSIRDDLQVPSSPYFPAYAQGQGPPPMVQERFQSIISQLFQYRIIRCGGAVDDDMANIIVAQLLYLDAVDPTKDIVMYVNSPGGSVTAGMAIFDTMRHIRPDVSTVCVGLAASMGAFLLSAGTKGKRYSLPNSRIMIHQPLGGAQGGQTDIDIQANEMLHHKANLNGYLAYQTGQSLEKINQDTDRDFFMSAKEAKDYGLIDGVIMNPLKALQPLAAA

SEQ ID NO: 5321 - DNA, 1232 bp, Zea mays
  misc_feature (1)..(1232): Ceres cDNA ID no. 22005724
  misc_feature (1)..(1232): Ceres CLONE  ID no. 1063922
  misc_feature (1)..(1232): Also known as  Ceres CDNA ID no. 24360963
ccctcgctgttccaaagccttactactcgcctcggccagtcgcctccgccaccaaaaccctaaccctagccccggagctcaggcgacgctcgcgcctccaaatggacgggggaggcacgcatcgcacgccggaggacgtgttcagggatttccgcgcgcggcgggccggcatgattaaggcgctcaccaccgatgtggagaagttctatcagcagtgcgacccagagaaagagaatctatgtctgtatggtcttcccaatgaaacatgggaagtgaacttgcctgcagaggaggttcccccagaacttccagagccggcactgggaattaattttgctcgggatgggatggatgagaaagattggttgtcacttgttgcggtgcacagtgatgcctggttgctagcagtagccttctactttggagcaagattcgggtttgacaaagaatccaggaagcggctttttagcatgataaacaacctccccaccatatatgaggttgtcaccggaactgcgaagaagcaggtcaaagaaaaacaccccaaaagcagcagcaagataaataaatctggcactaagccatctcgccagccagaacccaactcaaggggtccaaagatgccaccacctccgaaggatgaggacgacagtggaggcgaggaagaagagggagaagaacatgaaaaggcattatgtggtgcgtgtaacgataactatggacaggatgaattctggatctgctgtgatgcttgtgagacatggttccacggtaagtgtgtgaagatcactcctgccaaagctgagcacatcaagcactacaaatgcccaaattgcagcagcagtagcaagagggccagagcatgatatcggattcctccatggctcatgtctgaagatccaaggatttgactcactgtaaagacgcatgtgggacggaatgcccaatggatgtgcattcagttgttgctttgagattaataccagctttaggggtcttgctgtgttgttatttggtgtatgtcggtgatgttctagatttacttgtagtcgtagcaactaattgtaacagcttgtatgtcttggagccttgtcagtgcgcctgttctggactctcagtgtcctaggtcccgtgatgtatcatgtcatcatgtacccttgttgtaatttgttgaagaatcgcctgttatcttagcttttacagcctagttatttggaaaaaaaaaaaaaaaa

SEQ ID NO: 5322 - protein, 254 aa, Zea mays
  misc_feature: PFam Name: Extensin_2; PFam Description: Extensin-like region
  misc_feature: GI Number: 34898274; NR Description: similar to NBS-LRR type resistance gene [Oryza sativa (japonica cultivar-group)] >gi|24060173|dbj|BAC21289.1| similar to NBS-LRR type resistance
  misc_feature: GI Number: 34898268; NR Description: similar to NBS-LRR type resistance gene [Oryza sativa (japonica cultivar-group)] >gi|24060170|dbj|BAC21286.1| similar to NBS-LRR type resistance
  misc_feature: GI Number: 50948073; NR Description: putative Pi-b protein [Oryza sativa (japonica cultivar-group)] >gi|7415941|dbj|BAA93618.1| NBS-LRR type resistance gene [Oryza sativa] >gi|30060400|dbj|BAC75861.1| putative Pi-b protein [Oryza
  misc_feature: GI Number: 62734682; NR Description: NB-ARC domain, putative
  misc_feature: GI Number: 50945701; NR Description: putative disease resistance protein [Oryza sativa (japonica cultivar-group)] >gi|37806188|dbj|BAC99691.1| putative disease resistance protein
MDGGGTHRTPEDVFRDFRARRAGMIKALTTDVEKFYQQCDPEKENLCLYGLPNETWEVNLPAEEVPPELPEPALGINFARDGMDEKDWLSLVAVHSDAWLLAVAFYFGARFGFDKESRKRLFSMINNLPTIYEVVTGTAKKQVKEKHPKSSSKINKSGTKPSRQPEPNSRGPKMPPPPKDEDDSGGEEEEGEEHEKALCGACNDNYGQDEFWICCDACETWFHGKCVKITPAKAEHIKHYKCPNCSSSSKRARA

SEQ ID NO: 5323 - DNA, 830 bp, Zea mays
  misc_feature (1)..(830): Ceres cDNA ID no. 22005725
  misc_feature (1)..(830): Ceres CLONE  ID no. 1064165
  misc_feature (1)..(830): Also known as  Ceres CDNA ID no. 23827957
tttcccgagccggaggtggacgaggtaagaagaagcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacactatcctgttgaggggacccaagaatgcccgtgaggcggtgaggcacttcggcaaagcacctggtgtgccgcacagccataccaagccctatgtgcgctccaagggtaggaagtttgagaaggctcgtggtaggaggaacagccgtggcttcaaggtttaagtcgccctttcttgttagtcgctgtttgcgtggagcggctgttgttctgtttgagcaattgacagtaattagtaaagtactttgtactgagagtagcaaaatctatcgccccagtgtttgaatgatattttgcaagattcttatcgctgccaaaaaaaaaaaaaaaa

SEQ ID NO: 5324 - protein, 188 aa, Zea mays
  misc_feature: PFam Name: Ribosomal_L18e; PFam Description: Eukaryotic
  misc_feature: GI Number: 57471708; NR Description: ribosomal protein L18
  misc_feature: GI Number: 50939929; NR Description: putative cytoplasmic ribosomal protein L18 [Oryza sativa (japonica cultivar-group)] >gi|34393858|dbj|BAC83538.1| putative cytoplasmic ribosomal protein L18 [Oryza sativa (japonica ribosomal protein L18 [Oryza
  misc_feature: GI Number: 606970; NR Description: cytoplasmic ribosomal
  misc_feature: GI Number: 6714451; NR Description: putative 60S ribosomal protein L18 [Arabidopsis thaliana] >gi|16974509|gb|AAL31164.1| AT3g05590/F18C1_14 [Arabidopsis thaliana] >gi|21431838|sp|P42791|RL18_ARATH 60S ribosomal protein (RPL18B)
  misc_feature: GI Number: 23397141; NR Description: putative 60S ribosomal protein [Arabidopsis thaliana] >gi|21689771|gb|AAM67529.1| putative 60S ribosomal protein [Arabidopsis thaliana] >gi|15810153|gb|AAL07220.1| putative 60S ribosomal protein
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIQEVPAMKVTALRFTETARARIVNAGGECLTFDQLALRAPTGENTILLRGPKNAREAVRHFGKAPGVPHSHTKPYVRSKGRKFEKARGRRNSRGFKV

SEQ ID NO: 5325 - DNA, 1037 bp, Zea mays
  misc_feature (1)..(1037): Ceres cDNA ID no. 22005726
  misc_feature (1)..(1037): Ceres CLONE  ID no. 1064222
  misc_feature (1)..(1037): Also known as  Ceres CDNA ID no. 23828540
agaacaccccaactcacaaacgtgctaaacacaaacaaactctcgagatggccgccacttcaacagccgctgctgcttcttccatcatgggtactcgggtggtttccgacatcaactccggttcaagcaggttcacagcccggtttggattcgggaccaagaaggccgcagctcccaagaaggctaagacggttatctcagaccggcctctgtggttcccaggcgcgaaatctcccgagtatctcgacggttcgctggtcggagactacggttttgaccctttcggtttaggcaaaccggcggagtatctccagtttgatcttgactctctggaccagaacttagccaagaacatagccggagacgtgatcgggacccgtaccgaggccgctgaccccaagtcaacgccgtttcagccgtacagtgaggtctttgggctccagaggttcagagagtgtgagctgatccacgggagatgggctatgcttgcaactctcggtgctctctccgtcgagtggctcaccggtgttacttggcaagacgccggcaaggtagagctagtggatggatcgtcctatttaggacagccattaccgttctctatctcgacattgatttggatcgaagtgttggtgattggttacattgagttccaaagaaacgctgagttggactcagagaagcgtttgtatccaggaggcaagttcttcgacccgctcgggctagcttctgacccggagaagaaggctcagcttcagctggctgagatcaaacacgctcgtttagcgatggttgctttcttgggatttgcggttcaggcagctgcaacgggtaaaggaccgctcaacaactgggcgactcaccttagtgacccgcttcacaccaccatcatcgacaccttctcgtcctcttgatctggttgctttagcttttattggtgtgtaatgtaatgatgtccatcttgaaaacaaaagtttatgtaaacagagttcttgaaagtactctcaagtatcattggactaaaaaaaaaaaaaaaa

SEQ ID NO: 5326 - protein, 288 aa, Zea mays
  misc_feature: PFam Name: Chloroa_b-bind; PFam Description: Chlorophyll A-B
  misc_feature: GI Number: 15081739; NR Description: AT5g01530/F7A7_50
  misc_feature: GI Number: 22137102; NR Description: At5g01530/F7A7_50 [Arabidopsis thaliana] >gi|7327812|emb|CAB82269.1| chlorophyll a/b-binding protein CP29 [Arabidopsis thaliana] >gi|298036|emb|CAA50712.1| CP29 [Arabidopsis thaliana]
  misc_feature: GI Number: 4689382; NR Description: chlorophyll a/b binding
  misc_feature: GI Number: 20260162; NR Description: chlorophyll a/b-binding
  misc_feature: GI Number: 23198310; NR Description: chlorophyll a/b-binding protein CP29 [Arabidopsis thaliana] >gi|13877547|gb|AAK43851.1|
MAATSTAAAASSIMGTRVVSDINSGSSRFTARFGFGTKKAAAPKKAKTVISDRPLWFPGAKSPEYLDGSLVGDYGFDPFGLGKPAEYLQFDLDSLDQNLAKNIAGDVIGTRTEAADPKSTPFQPYSEVFGLQRFRECELIHGRWAMLATLGALSVEWLTGVTWQDAGKVELVDGSSYLGQPLPFSISTLIWIEVLVIGYIEFQRNAELDSEKRLYPGGKFFDPLGLASDPEKKAQLQLAEIKHARLAMVAFLGFAVQAAATGKGPLNNWATHLSDPLHTTIIDTFSSS

SEQ ID NO: 5327 - DNA, 1031 bp, Zea mays
  misc_feature (1)..(1031): Ceres cDNA ID no. 22005727
  misc_feature (1)..(1031): Ceres CLONE  ID no. 1064544
  misc_feature (1)..(1031): Also known as  Ceres CDNA ID no. 23827651
atccaccacagctttgctgcaaccaccagtgaagcactcttgatcaacaaactctagctgatcagtgctagctaagcttgctacatagcaagccatgggttactccaaaaacctaggggctagcctgtttgccatgctgctgcttgctccggccgtcctggcctccgaccctgaccctctccaagacttctgcgttgctgacctcgacggcaaggcggtctctgtgaacgggcatccatgcaagcccatgtcggaggccggtgacgacttcctcttctcgaccaagctggccaaggccggcaacacgtccaccccgaatggctcggccgtgacggagctcgacgtggccgagtggcccggtacgaacacgctgggtgtgtccatgaaccgtgtggacttcgcgccgggaggcaccaacccgccgcatgtccacccgcgcgggaccgagatcggcatggtgatgaaaggtgagctcctcgttggaatcctcggaagcctcgactccggaaacaagctctactctagggtggtgcgtgctggagagacgttcctcatcccacgcgggctcatgcacttccagttcaacgttggtaagacagaggcctacatggttgtttccttcaacagccagaaccccggcatcgttttcgtgccgctcatgctcttcggttccaacccgccaatccccacgccggtgctcaccaaggcactaagggtggaggccggggtcgtcgaacttctcaagtccaagttcgctggtgggtcttaatccctgggagcttgccctgaaatgatgagtatataatttgatatatgcatgccaatgagatttaataattgttcagcagaagacacgtattcaagcttctagctaagctcgcatgcagttgtaataagattgaataagttagcctcgcggtttagccttcagagccaatacgaggaatcgaagtgtactgcttttcattgtcgtatttgttcttttcactgaatggaatatataattatcattttcaaaaaaaaaaaaaaaa

SEQ ID NO: 5328 - protein, 224 aa, Zea mays
  misc_feature: PFam Name: Cupin_1; PFam Description: Cupin
  misc_feature: GI Number: 1772597; NR Description: pSBGer1 [Triticum
  misc_feature: GI Number: 2266668; NR Description: oxalate oxidase [Hordeum
  misc_feature: GI Number: 1171937; NR Description: Oxalate oxidase 2
  misc_feature: GI Number: 14278247; NR Description: Chain A, Crystal
  misc_feature: GI Number: 46408929; NR Description: oxalate oxidase
MGYSKNLGASLFAMLLLAPAVLASDPDPLQDFCVADLDGKAVSVNGHPCKPMSEAGDDFLFSTKLAKAGNTSTPNGSAVTELDVAEWPGTNTLGVSMNRVDFAPGGTNPPHVHPRGTEIGMVMKGELLVGILGSLDSGNKLYSRVVRAGETFLIPRGLMHFQFNVGKTEAYMVVSFNSQNPGIVFVPLMLFGSNPPIPTPVLTKALRVEAGVVELLKSKFAGGS

SEQ ID NO: 5329 - DNA, 1659 bp, Zea mays
  misc_feature (1)..(1659): Ceres cDNA ID no. 22005728
  misc_feature (1)..(1659): Ceres CLONE  ID no. 1064791
  misc_feature (1)..(1659): Also known as  Ceres CDNA ID no. 23827740
agaacaaacccagttgaattttcccagaaagttttctcctttttttcttgaattaagcttaacagtgagaaaagatggagaaagccactgaaaggcagaagattctgattcgtcatctcaatccactttcttcttctccttctcttcctagcattaatgataataaacctactcttctctccgctgtgaactgtgctgctgagctttccccaatggctgccttcggagacgacgttgtgatcgttgcggcgtatcgcactgccatctgcaaagctaaacgtggagggttcaaagatactctcccagatgatcttcttgcttctgttctcaaggctgtggtggaaaggacgtctttggatccaagtgaagttggggatattgttgttggtaccgttatagctcctggctctcagagagccatggagtgtagagtagctgcttactttgctggctttcctgactctgtgccaatcagaactgtcaacagacaatgctcatcaggactacaagctgttgctgatgttgctgcttccatcagagctggatattacgacattggtattggtgctggagttgagtccatgtcgattgatcacactgctggaggtggctttcacacaacaaacccgagggcacaagagtttcgtggagctcgtgactgcttgcttccgatgggcataacttctgaaaacgtagcagaaagatactgtgtcacaagagaagatcaagacatggctgcggtggagtctcacaagcgtgcagcagctgcaaacgcgtctggtaaactaaaggatgagatagttcctgttgcgactaagattgttgaccctgatacaaaagcagagaagccaattgttgtttctgttgatgatggtgtacgtccaaactcaaacatggctgatcttgcaaagctgaagacagtctttaaacctaatggttcaaccacagcaggcaatgctagtcagattagtgatggtgctggagctgtactgctgatgaagaggagcttggcgatgaagaagggacttcccattcttggaatattcaggagctttgctgttactggtgtggatccagctgtaatgggtatcggtccagcttacgccattcccgctgcagccaaccttgcaggactcaaagttagcgatatcgatctatttgagatcaatgaggcatttgcatctcagtatgtgtactgttgcaagaagctagagctggatgtggaaaaggtcaatgttaatggaggggccattgctattggccatcctcttggtgctacaggagctcgatgtgttgcgacattgttgcatgagatgaaacggagagggaaagactgccgctttggagttatttcaatgtgcataggcactggtatgggagccgcagctgtgtttgagagaggagactctgttgatgacttgtccaatgcgcgtgtggagactaatgggagcggtcactagaacaaggttgaataaggacaagcaatgaaagcactaagtcaaataaaaaagtgtgaagcttaaacagctctttcacattgttgaacaatgaacaatttgtcattctgagtttaaaatgtatcaactagtaacttgtgagtgaacaaagagtcaaatctaaaaagcaaagttacatctttcaccgaaaaaaaaaaaaaaa

SEQ ID NO: 5330 - protein, 461 aa, Zea mays
  misc_feature: PFam Name: Thiolase_N; PFam Description: Thiolase,
  misc_feature: PFam Name: Thiolase_C; PFam Description: Thiolase,
  misc_feature: GI Number: 9758887; NR Description: 3-keto-acyl-CoA thiolase 2 [Arabidopsis thaliana] >gi|19310493|gb|AAL84980.1| AT5g48880/K24G6_22 [Arabidopsis thaliana] >gi|3220237|gb|AAC23571.1| peroxisomal 3-keto-acyl-CoA thiolase 2
  misc_feature: GI Number: 22531233; NR Description: 3-keto-acyl-CoA thiolase 2 [Arabidopsis thaliana] >gi|27311977|gb|AAO00954.1| 3-keto-acyl-CoA thiolase 2 [Arabidopsis thaliana] >gi|3192893|gb|AAC19122.1| peroxisomal-3-keto-acyl-CoA thiolase 1
  misc_feature: GI Number: 37549269; NR Description: 3-ketoacyl-CoA thiolase
  misc_feature: GI Number: 393707; NR Description: 3-ketoacyl-CoA thiolase;
  misc_feature: GI Number: 421810; NR Description: acetyl-CoA
MEKATERQKILIRHLNPLSSSPSLPSINDNKPTLLSAVNCAAELSPMAAFGDDVVIVAAYRTAICKAKRGGFKDTLPDDLLASVLKAVVERTSLDPSEVGDIVVGTVIAPGSQRAMECRVAAYFAGFPDSVPIRTVNRQCSSGLQAVADVAASIRAGYYDIGIGAGVESMSIDHTAGGGFHTTNPRAQEFRGARDCLLPMGITSENVAERYCVTREDQDMAAVESHKRAAAANASGKLKDEIVPVATKIVDPDTKAEKPIVVSVDDGVRPNSNMADLAKLKTVFKPNGSTTAGNASQISDGAGAVLLMKRSLAMKKGLPILGIFRSFAVTGVDPAVMGIGPAYAIPAAANLAGLKVSDIDLFEINEAFASQYVYCCKKLELDVEKVNVNGGAIAIGHPLGATGARCVATLLHEMKRRGKDCRFGVISMCIGTGMGAAAVFERGDSVDDLSNARVETNGSGH

SEQ ID NO: 5331 - DNA, 969 bp, Zea mays
  misc_feature (1)..(969): Ceres cDNA ID no. 22005729
  misc_feature (1)..(969): Ceres CLONE  ID no. 1064964
  misc_feature (1)..(969): Also known as  Ceres CDNA ID no. 23828082
gggaaatgggaaatggtcagatagatcctgcgagaacctaaacctaacactcgtttctttgtcatcaaaaaagattctctgtctctccgatcctcgtcgatctgaagaatctcggagaccactcacttcaatggcggaatctgtagcttctcaaactccgtcgctctccgagcaatatcatttggagaaggaagtgaagcaagacacaagtgcgaagcctgtcgaggttgcaccagaggttacttctcaagctgaagacgttagcaccgacaaagccagtgaagaatctcctgctgaggaagctgtttctgctgttgaggagaagtctgagtctcctcctgcttctgaagaggctcctcctgctgtggtagtggaagacagtgctgatgagactcctgttgcggtggaagagagtaatgacgaaaacgctagtgaagaagttgttgaggagactcctgatgagatcaagcttgagacagctcctgctgatttccgtttcccgacaactaaccaaacaaggcattgtttcacacgttacattgaatatcacagatgtgtagctgctaagggtgacgacgctccagaatgcgacaagttttcaaagttttaccgatctctttgccccggtgaatgggttgataagtggaacgagcaaagagagaatggaactttccctggtcctctttaagacactctcctgcctgaagaaaaatcttcttttgatgttaccttcatgatgtcagagctccaattacactgcagagtttaataagattttacagaaccagctcgtttggttccccttcataagatgtgagaatttaacaactataatctcaaattttttctcttttacctatatgctcatctcaagttttgaggatcttctgattttgaaatgttgttctgcctgattatatgcttttcaatggcgagcttcaatttttagtaccaaaaaaaaaaaaaaaa

SEQ ID NO: 5332 - protein, 185 aa, Zea mays
  misc_feature: PFam Name: COX6B; PFam Description: Cytochrome oxidase c
  misc_feature: GI Number: 20465723; NR Description: putative cytochrome c oxidase subunit [Arabidopsis thaliana] >gi|17381082|gb|AAL36353.1| putative cytochrome c oxidase subunit [Arabidopsis thaliana] >gi|6587843|gb|AAF18532.1| Subunit 6b of
  misc_feature: GI Number: 21554378; NR Description: cytochrome c oxidase
  misc_feature: GI Number: 37991922; NR Description: cytochrome c oxidase subunit 6b-1 [Oryza sativa (japonica cultivar-group)] >gi|50920887|ref|XP_470804.1| cytochrome c oxidase subunit 6b-1 [Oryza sativa (japonica cultivar-group)] sativa (japonica
  misc_feature: GI Number: 34906824; NR Description: putative cytochrome c oxidase subunit 6b-1 [Oryza sativa (japonica cultivar-group)] >gi|22296419|dbj|BAC10187.1| putative cytochrome c oxidase subunit
  misc_feature: GI Number: 22204116; NR Description: putative cytochrome c
MAESVASQTPSLSEQYHLEKEVKQDTSAKPVEVAPEVTSQAEDVSTDKASEESPAEEAVSAVEEKSESPPASEEAPPAVVVEDSADETPVAVEESNDENASEEVVEETPDEIKLETAPADFRFPTTNQTRHCFTRYIEYHRCVAAKGDDAPECDKFSKFYRSLCPGEWVDKWNEQRENGTFPGPL

SEQ ID NO: 5333 - DNA, 780 bp, Zea mays
  misc_feature (1)..(780): Ceres cDNA ID no. 22005730
  misc_feature (1)..(780): Ceres CLONE  ID no. 1065011
  misc_feature (1)..(780): Also known as  Ceres CDNA ID no. 23828379
acctcaaccgcaccacagctcagctcccacccactcccaaaccctctcgccggagccccagcaacccgccagcaagcaagatggacggcagcaaggcgaagaaggtggcggcgaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagcagaggtgctggagctggccgggaacgccgccaaggacaacaagaagagccgcatcgtgcccaggcacctgctgctggccatccgcaacgaccaggagctcgggaggctgctgtccggcgtcaccatcgcccacggcggcgtcatccccaacatcaacccggtgctgctccccaagaaggccgccgagaaggctgagaaggccgagaagaccgccaccaagtcgcccaagaaggccaccaagtcccccaagaaggccaccaaggcgtagatctggctccgagcgcccgtgccggtgaactggactgatggtgctccgtcagccctcgtgtgcctagtgtctctgtgttaagttagctgtggtgtgttccagagtgtgttgaagcttgttcttttgctttgccccgccatgtaaccgtgaacgaagaggaagcgtcttgcttcctctgttctgctatatcaatctggtttctaatgcagtgtttgtaaaaaaaaaaaaaaaa

SEQ ID NO: 5334 - protein, 155 aa, Zea mays
  misc_feature: PFam Name: Histone; PFam Description: Core histone H2A/H2B/H3/H4
  misc_feature: PFam Name: Pyr_redox_2; PFam Description: Pyridine
  misc_feature: PFam Name: Glutenin_hmw; PFam Description: High molecular
  misc_feature: PFam Name: FH2; PFam Description: Formin Homology 2 Domain
  misc_feature: PFam Name: 7tm_1; PFam Description: 7 transmembrane receptor
  misc_feature: GI Number: 121974; NR Description: HISTONE H2A.2.1
  misc_feature: GI Number: 121982; NR Description: HISTONE H2A.2.2
  misc_feature: GI Number: 729671; NR Description: Histone H2A >gi|7439704|pir||T02076 histone H2A - maize
  misc_feature: GI Number: 34914498; NR Description: putative histone H2A [Oryza sativa (japonica cultivar-group)] >gi|13873032|dbj|BAB44136.1| putative histone H2A [Oryza sativa
  misc_feature: GI Number: 7649159; NR Description: histone H2A [Euphorbia esula]
MDGSKAKKVAAKKFGGPRKKSVTKSIKAGLQFPVGRIGRYLKKGRYAQRVGSGAPVYLAAVLEYLAAEVLELAGNAAKDNKKSRIVPRHLLLAIRNDQELGRLLSGVTIAHGGVIPNINPVLLPKKAAEKAEKAEKTATKSPKKATKSPKKATKA

SEQ ID NO: 5335 - DNA, 1187 bp, Zea mays
  misc_feature (1)..(1187): Ceres cDNA ID no. 22005731
  misc_feature (1)..(1187): Ceres CLONE  ID no. 1065112
  misc_feature (1)..(1187): Also known as  Ceres CDNA ID no. 23828390
aaaaccctaagcttcttcgccgactatctccgatcgtgatccttcctaaaccctagcctcaccggtgattaagagctgatctaagatcatgagtttcaacaaagtgccgaacatccctggatctcctgctctctccgcgcttctcaaggtcagcgttatcggtggcctcggtgtctacgccatcactaacagcctctacaatgtcgagggtgggcatcgtgccgtcatgttcaaccgattaaccggtatcaaggaaaaggtgtacccggaaggtacgcactttatgttgccatggtttgagaggccaatcatctatgacgtccgtgcacgaccctatcttgttgagagcagcactggtagtcatgatcttcagacgatcaaaattggacttagggttctcacacgtcccatgggtgaccgtttgcctcatatttaccgaaccctaggcgagaattacagtgaaagggttctcccttccatcatccatgaaacactgaaggctgtggtggctcagtacaatgcaagccagctcatcactcagagagaagctgtgagcagagagatacgcaagattctgacggagagagcttcgaacttcgacattgctcttgatgatgtctccatcacgactctcacttttggcaaagagttcacagctgcaatcgaggcaaagcaagtcgctgctcaggaagctgaacgtgccaagttcattgtggagaaagctgagcaagacaagagaagtgctgttatccgtgcggagggagaagctaaaagtgctcaacttataggacaagcaattgcaaacaatgaggcattcataactctgagaaagatcgaagctgcaagagagattgctcagaccattgcaaaatcagctaacaaggtgtacctgagctccaacgatctgttgcttaaccttcaagcgatgaacttggagcctagctcgaagaagtgaaaacaaggaactatatagtaagttccatccgtttctctcaaaatgactattttgtccattatcgtgatcgatcctggaactgcttactttaagtcgagacattgaaacttggattagctttggtcgtcatgttcttgtttatattttcttgcgctttccgggaaaattgtttggctggatttaaaaaataataataacaaacatattcgtatggctaaaaaaaaaaaaaaaa

SEQ ID NO: 5336 - protein, 288 aa, Zea mays
  misc_feature: PFam Name: Band_7; PFam Description: SPFH domain / Band 7 family
  misc_feature: GI Number: 17104775; NR Description: putative prohibitin 2 protein [Arabidopsis thaliana] >gi|13878109|gb|AAK44132.1| putative prohibitin 2 protein [Arabidopsis thaliana] >gi|4099801|gb|AAD09244.1| prohibitin-like protein [Arabidopsis
  misc_feature: GI Number: 12751303; NR Description: prohibitin 1-like
  misc_feature: GI Number: 21593626; NR Description: prohibitin-like protein
  misc_feature: GI Number: 23198006; NR Description: prohibitin-like protein [Arabidopsis thaliana] >gi|7269706|emb|CAB81439.1| prohibitin-like protein [Arabidopsis thaliana] >gi|2842494|emb|CAA16891.1| prohibitin-like protein [Arabidopsis
  misc_feature: GI Number: 21593956; NR Description: putative prohibitin [Arabidopsis thaliana] >gi|21387071|gb|AAM47939.1| putative prohibitin [Arabidopsis thaliana] >gi|4586035|gb|AAD25653.1| putative prohibitin [Arabidopsis thaliana]
MSFNKVPNIPGSPALSALLKVSVIGGLGVYAITNSLYNVEGGHRAVMFNRLTGIKEKVYPEGTHFMLPWFERPIIYDVRARPYLVESSTGSHDLQTIKIGLRVLTRPMGDRLPHIYRTLGENYSERVLPSIIHETLKAVVAQYNASQLITQREAVSREIRKILTERASNFDIALDDVSITTLTFGKEFTAAIEAKQVAAQEAERAKFIVEKAEQDKRSAVIRAEGEAKSAQLIGQAIANNEAFITLRKIEAAREIAQTIAKSANKVYLSSNDLLLNLQAMNLEPSSKK

SEQ ID NO: 5337 - DNA, 990 bp, Zea mays
  misc_feature (1)..(990): Ceres cDNA ID no. 22005732
  misc_feature (1)..(990): Ceres CLONE  ID no. 1065990
  misc_feature (1)..(990): Also known as  Ceres CDNA ID no. 23828412
ctctcggtctcgctagggttttgggattttagcctccagcgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgttaaggtgttcgcggcggtgcccgtgaagcccagcgccgagttcctgaacgctgcccgctggtacgacgccgtcgccgcggccgtttcttcaaggttccctggccaggcctctggggtgagtgcatcctcggctcctgctgcagctgctcctgctgcttccaaggatgaagatgatgacgatgacatggatctgttcggcgatgagaccgaggaggacaagaaagcagcagctgagcgtgaggctgccaagcctgcaaagaagaaagaaagtggcaaatcctccgtcctcatggacatcaagccatgggacgatgagactgacatgaagaagttggaggaggctgtccgcagtgttcaaatggagggtctcacctggggtgcatctaagcttatgcctgtgggttatggcatcaagaagctccagatcatgctgacgatcatcgacgaccttgtgtctgtcgacacccttattgaggaagtgctctgtgaggcgcccatcaacgagtatgtccagtcgtgtgacatcgttgccttcaacaagatctagaatctttgttcgcccacctgttgctgctggattcttggtactgggattggttgatctggaaaacattatgtcgtcccatttagttacccctcttacagaaatgctactggttttgtttttgagtgatgccctggtcttgaatgcctgctacctttaaatagttgaattgctgagcggtttgtaatggcgaaacatctatcatgtggagtaaaatcagtctttgataaaaaaaaaaaaaaaa

SEQ ID NO: 5338 - protein, 218 aa, Zea mays
  misc_feature: PFam Name: EF1_GNE; PFam Description: EF-1 guanine
  misc_feature: PFam Name: GST_C; PFam Description: Glutathione
  misc_feature: GI Number: 218161; NR Description: elongation factor 1 beta' [Oryza sativa (japonica cultivar-group)] >gi|322851|pir||S29224 translation elongation factor eEF-1 beta' chain - rice >gi|232031|sp|P29545|EF1D_ORYSA ELONGATION FACTOR 1-BETA'
  misc_feature: GI Number: 48209911; NR Description: putative elongation
  misc_feature: GI Number: 15810631; NR Description: putative elongation factor 1B alpha-subunit [Arabidopsis thaliana] >gi|13430784|gb|AAK26014.1| putative elongation factor 1B alpha-subunit [Arabidopsis thaliana] >gi|6686821|emb|CAB64730.1|
  misc_feature: GI Number: 9759378; NR Description: elongation factor 1B alpha-subunit [Arabidopsis thaliana] gi|6686819|emb|CAB64729.1| elongation factor 1B alpha-subunit [Arabidopsis thaliana] gi|25456755|pir||T52559 translation elongation factor eEF1Balpha
  misc_feature: GI Number: 3288113; NR Description: elongation factor 1-beta [Beta vulgaris subsp. vulgaris] >gi|7443457|pir||T14552 translation elongation factor eEF-1 beta chain homolog - beet >gi|6015063|sp|O81918|EF1B_BETVU ELONGATION FACTOR 1-BETA
MAVTFSDLHTADGLKALEAHLAGKTYISGDGITKDDVKVFAAVPVKPSAEFLNAARWYDAVAAAVSSRFPGQASGVSASSAPAAAAPAASKDEDDDDDMDLFGDETEEDKKAAAEREAAKPAKKKESGKSSVLMDIKPWDDETDMKKLEEAVRSVQMEGLTWGASKLMPVGYGIKKLQIMLTIIDDLVSVDTLIEEVLCEAPINEYVQSCDIVAFNKI

SEQ ID NO: 5339 - DNA, 1108 bp, Zea mays
  misc_feature (1)..(1108): Ceres cDNA ID no. 22005733
  misc_feature (1)..(1108): Ceres CLONE  ID no. 1066012
  misc_feature (1)..(1108): Also known as  Ceres CDNA ID no. 23827825
agctagcttacacagaagggcgattcgatcgaggccgccgccccgccgccgccgccgccggagacgatcccctgcagtcagttagttaagctacaaaatggcctcgctggacaccgtcagaggagatcttggcctggttgttttgtacctaagcaaggctgaggcaagagataagatctgtagagctatacaatatggatccaagttcctgagcaacggacaaccaggacctgcacagaatgtcgacaaatcaactagtctagctcggaaagttttccgactgtttaagtttgttaatgatctccaagctctgattagcccccctgccaaaggaactccacttccgctgatcttacttggaaagtcgaagaacgcgatgctgtcaactttcctctttctggaccaaattgtttgggctgggagaacaggagtatacaagaacaaggagcgagcagagtttcttggcaggatagcattttattgctttctcggatccaatacctgtactactatcatcgagctagccgagcttcagcggctttccaaatcgatgaagaagttagagaaggacctcaagcaccaagagctgtacaagaacgagcagtatcggatgaagctgaagaagtccaacgagaggctgctcgccctcatcaaatcgagcctcgacatagtcgtcgccgtggggctgctgcaactggcaccaaaaaaggtcactcctcgcgtcacgggtgcgtttgggttcgctagctcgctcatcgcctgttaccagttgcttccagccccagccaaatccaagtgatctgcctgcccacctcgggccaggcagctggtgcattgattggtgaaacggcggttgctgtcgccccttgttgtcgctgatactgataagaaataaatctggaccgaactgtccgtccccgtaggatataaccaaggattattgctgtgcatgctggcattgccgagggccatctcatagcctggttgatctgccttgccttagacttgatcatgtagcacgcttgtatttgtatggtccggtgtgccactatcatactacaactgttgcgaaataattagaaatttcataccaaaaaaaaaaaaaaaa

SEQ ID NO: 5340 - protein, 233 aa, Zea mays
  misc_feature: PFam Name: PEX11; PFam Description: Peroxisomal biogenesis
  misc_feature: GI Number: 8489788; NR Description: unknown [Lycopersicon
  misc_feature: GI Number: 16323256; NR Description: At2g45740/F4I18.28 [Arabidopsis thaliana] >gi|14335058|gb|AAK59793.1|
MASLDTVRGDLGLVVLYLSKAEARDKICRAIQYGSKFLSNGQPGPAQNVDKSTSLARKVFRLFKFVNDLQALISPPAKGTPLPLILLGKSKNAMLSTFLFLDQIVWAGRTGVYKNKERAEFLGRIAFYCFLGSNTCTTIIELAELQRLSKSMKKLEKDLKHQELYKNEQYRMKLKKSNERLLALIKSSLDIVVAVGLLQLAPKKVTPRVTGAFGFASSLIACYQLLPAPAKSK

SEQ ID NO: 5341 - DNA, 1043 bp, Glycine max
  misc_feature (1)..(1043): Ceres cDNA ID no. 22005735
  misc_feature (1)..(1043): Ceres CLONE  ID no. 1075991
  misc_feature (1)..(1043): Also known as  Ceres CDNA ID no. 24403179
aaaaaactcatctccctcagtctccaagctctctctctctctctgcgaaactcacgagcagaaaagatgataaagagacgattttacaagctagagcatggtgacaaagacagtggatccgactcctcttgcttctcttctgattccgatcctgagtctgaagaagaagaagaagaatcagagcaatccgaatccgaagactccgttgcagaagcttccgaagacgatgatgattccgtctcagagggtgaaggagaagatgactccccagctgctggtgaggatgctgatgactctgatggtggtgcctatcgagggagacatgagaagacatcgatgcaatacggtttagaagaaccaccggaagaggaggaagagaactatattctaggttttatgattaaatgcaaatctgtttataaatgcagatattgtccaaacactgtttgtttgaatgagaaaactatgcaagaacatgtttcctccaagaagcatgctcgttctgagaaactaatgaaagaagagaagttcggaactgatgatgatgaagatgttgatgatcctgagaagccatctcaggagaagcagataaaagggaacaggagatcacaaagaaagggtaagagatcacaaaagcaaggaaacctcagaacagatgatgacaaagttgatgatcctaaaacgccatctcaggagaagcaggttaaaggaaacagaaaatcaagaagacaaggtatgatggtgtcacaaaaacaggaaaagggttcatcgaccacaaacggagtgaaggcaactgataagacgctaaaatctagaaagaaaatgcgtcaaactaaggactgagaccagttatctccagcaatatgaaaggcccgaaaggttcatctttttcacttggaaatcgatggacaatgaagaaaacataagacagtgtacgttatgtgtcagattatgtgttatttaactgatatataattctgaacaattgagatttgagttatacagttgtgtgttctgttttgtcgtcaaaaaaaaaaaaaaaa

SEQ ID NO: 5342 - protein, 258 aa, Glycine max
  misc_feature: PFam Name: Chromadorea_ALT; PFam Description: Chromadorea
  misc_feature: PFam Name: MFAP1_C; PFam Description:
  misc_feature: PFam Name: DMP1; PFam Description: Dentin matrix protein 1 (DMP1)
  misc_feature: PFam Name: TFIIF_alpha; PFam Description: Transcription
  misc_feature: PFam Name: Prothymosin; PFam Description:
  misc_feature: GI Number: 50901680; NR Description: P0436D06.15 [Oryza sativa (japonica cultivar-group)] >gi|13359054|dbj|BAB33276.1|
  misc_feature: GI Number: 23619192; NR Description: microfibril-associated protein homologue, putative [Plasmodium falciparum 3D7] >gi|23615399|emb|CAD52390.1| microfibril-associated protein
  misc_feature: GI Number: 23479053; NR Description: mature-parasite-infected
  misc_feature: GI Number: 60468205; NR Description: PHD Zn finger-containing
  misc_feature: GI Number: 21309834; NR Description: glutamic acid-rich
MIKRRFYKLEHGDKDSGSDSSCFSSDSDPESEEEEEESEQSESEDSVAEASEDDDDSVSEGEGEDDSPAAGEDADDSDGGAYRGRHEKTSMQYGLEEPPEEEEENYILGFMIKCKSVYKCRYCPNTVCLNEKTMQEHVSSKKHARSEKLMKEEKFGTDDDEDVDDPEKPSQEKQIKGNRRSQRKGKRSQKQGNLRTDDDKVDDPKTPSQEKQVKGNRKSRRQGMMVSQKQEKGSSTTNGVKATDKTLKSRKKMRQTKD

SEQ ID NO: 5343 - DNA, 1961 bp, Zea mays
  misc_feature (1)..(1961): Ceres cDNA ID no. 22005736
  misc_feature (1)..(1961): Ceres CLONE  ID no. 1222684
  misc_feature (1)..(1961): Also known as  Ceres CDNA ID no. 23830189
acggcgaccgatgccgctgctgctgcgcggcgcctccctcctccgcctctgccagtgtaccagtgggctctcaagtgtgaaatttagttcaagagtaacggtactagtgaatctcaacgccatgagggacggaatgcgggccacatattcacgtagagctgcctctaagaacagtgaggtcaagaaagatgagcagccactcacagagaaggaagatgctgctgaaagtgatttggagatggagcgagggaggagcagcagccctagccagctccaatcaatgactgtcaaggagctcagggagctcacgaggaggaggggtatttctgtgaaaggtaccaagaaagatttagtatcagcactgatgaattctatggccgtggaagcaaatggtgaagagggaaagtcatccgttgagctggttagccccttggaagtacctttgaaaagaaaaggtggtgcttctgttgtggttgaacaaaaactagaaagttctgagattatttctgaaacacctaacaagaaaagaagtagaacaaaacaaaaatcaagcaagaacaccacttgtcaggaaatttcggtgactaatgtcaagctaagtaagactgttgtccagaaggaaacagttgacggattaagtcctgatgatgattcagagccttggactatactcgtgcataagaaaccagaagccagctggattccatacaaccctaggactatgaggcctccacctcttagcaaggatacacgggctctgaagattatgtcatggaatgtcaatggattgaaagcattgctcaaatcaagaggcttctctgtgcagcagttagcacagagggaggactttgatgtgctttgcttacaagaaacaaaaatgcaggagaaggatattgaagttattaaggacactttgcttgatggctacacaaatagtttctggacttgcagtgtgtcaaagcttggctattctggcactgcaataatttcaagagtcaaaccactgtcgatcaagtatgggcttggtataccagaccatgatactgaagggagggttgtgactgtagagtttgatgacttctacctgttaactgcttatgtaccaaactctggtgatggtctaaaaagattgacttacagggtcacagagtgggatccatcccttggtaactacatgaaagaattggagaaatcgaagcctgtcatactaaccggtgatcttaattgtgcgcatcaggagattgatatacatgaccctgctggaaatcgtagaagtgctggcttcacaaacgaggaaagagaatcatttgggaccaattttttgtccaaagggttcgttgatacgtttcggaaacagcatcctaatgttgttgcctatagttactgggggtacagacataatgcccggaagacaaacaaaggttggcgcctggattactttcttgtgtccgaatcaatcgcagaaaaagtgcatgattcatatattcttccggacatctctgccagtgatcacagtccccttggtctcgtgctgaagctgtaggctgtatcacaggctatgccaaacattcagtctgaagcttgtgccatatttctcagacagcgatgcttattcctgatggtttctggttcgttcagattcctggcaggaacaaggacttttgtcagactattagtgaaacaaggctttgtaatgcactgagcagatttgagactattagtggacaacttactgttagcaaagctgcacctttgtaatgtaaatatgcggccatatcttgtgctgcacttgtgcagctcaatatgagcagcaggggaagctcattacctggtcatggaattatgatactgaccttaacctgttgaggtctttaaactatcttgtcatgtgctgtgccgctgatggcgtcagaaaataactgtgccatgcaatttcacgcaaaaaaaaaaaaaaaaaaaaa

SEQ ID NO: 5344 - protein, 510 aa, Zea mays
  misc_feature: PFam Name: Exo_endo_phos; PFam Description:
  misc_feature: PFam Name: SAP; PFam Description: SAP domain
  misc_feature: GI Number: 55297696; NR Description: putative DNA-(apurinic or apyrimidinic site) lyase (ARP) [Oryza sativa (japonica cultivar-group)] gi|55296319|dbj|BAD68137.1| putative DNA-(apurinic or apyrimidinic site) lyase (ARP) [Oryza sativa
  misc_feature: GI Number: 34908948; NR Description: putative exodeoxyribonuclease [Oryza sativa (japonica cultivar-group)] >gi|19570990|dbj|BAB86417.1| putative exodeoxyribonuclease [Oryza sativa (japonica cultivar-group)] >gi|20804742|dbj|BAB92428.1|
  misc_feature: GI Number: 472869; NR Description: ARP protein [Arabidopsis
  misc_feature: GI Number: 3241944; NR Description: DNA-(apurinic or apyrimidinic site) lyase (ARP) [Arabidopsis thaliana] >gi|8488963|sp|P45951|ARP_ARATH Apurinic endonuclease-redox protein (DNA-(apurinic or apyrimidinic site) lyase)
  misc_feature: GI Number: 55297697; NR Description: putative DNA-(apurinic or apyrimidinic site) lyase (ARP) [Oryza sativa (japonica cultivar-group)] gi|55296320|dbj|BAD68138.1| putative DNA-(apurinic or apyrimidinic site) lyase (ARP) [Oryza sativa
MPLLLRGASLLRLCQCTSGLSSVKFSSRVTVLVNLNAMRDGMRATYSRRAASKNSEVKKDEQPLTEKEDAAESDLEMERGRSSSPSQLQSMTVKELRELTRRRGISVKGTKKDLVSALMNSMAVEANGEEGKSSVELVSPLEVPLKRKGGASVVVEQKLESSEIISETPNKKRSRTKQKSSKNTTCQEISVTNVKLSKTVVQKETVDGLSPDDDSEPWTILVHKKPEASWIPYNPRTMRPPPLSKDTRALKIMSWNVNGLKALLKSRGFSVQQLAQREDFDVLCLQETKMQEKDIEVIKDTLLDGYTNSFWTCSVSKLGYSGTAIISRVKPLSIKYGLGIPDHDTEGRVVTVEFDDFYLLTAYVPNSGDGLKRLTYRVTEWDPSLGNYMKELEKSKPVILTGDLNCAHQEIDIHDPAGNRRSAGFTNEERESFGTNFLSKGFVDTFRKQHPNVVAYSYWGYRHNARKTNKGWRLDYFLVSESIAEKVHDSYILPDISASDHSPLGLVLKL

SEQ ID NO: 5345 - DNA, 959 bp, Glycine max
  misc_feature (1)..(959): Ceres cDNA ID no. 22005737
  misc_feature (1)..(959): Ceres CLONE  ID no. 1240407
  misc_feature (1)..(959): Also known as  Ceres CDNA ID no. 24403492
ctcttcttaatctctctgctattggtttctttgcaggaatcaaagcatatattgttttgaaacttgatgagtgaagtccctggttcccggtttaggtttatgacccacttggttcaatctttctccgttgtcttcctctactggttctatgttttctcgttgatctccagtttcccatcgcatattattattatataacttagtaatatagttatcagtgtctctgggtcctgcgtcctaattaggattagtttattttataatatgtccatgtccatggcctcatcaagtggaaactcctctattagcacaaaatctcagagctcagggtctgagggtgatttgcaggtcgtgataacagacgagaggaagaacaagaggaagcaatcgaatcgtgaatcggcgagaagatctcggatgcgaaagcgtaaccacttggaccaactcactaagcagctctcacagctcgcaaagaacaacggcgaaatcctcgccaccatagacatcaccacgcagcactatctgaacgttgaggcagagaattccattctaagggcccaaatgggtgagcttagccaacggctccaatcgctcaacgacatcgtccacgacatcatcatcaacacaaccaccacctacgaaagggactgttatctaacaagcgcacaaaatttcaccaccaccacctacacgctctgtcttaaccaacccgtttttcagtggtgaattgtcaccctcgtcctctgtggatcttgaccataaaagaaaggaaaagtgtgcgtctgggtgaatcttctcttggaggaatcaatgtcaatcagtgaaaaaaaattaagttcatattagtacagtacttagggtggggctatgttaattgttaaacagaatttgcgcaaagtgcttattgaaaatgacatagtggcctgcaactatatttcagatcaaaaaaaaaaaaaaaa

SEQ ID NO: 5346 - protein, 959 aa, Glycine max
  misc_feature: PFam Name: bZIP_1; PFam Description: bZIP transcription factor
  misc_feature: PFam Name: bZIP_2; PFam Description: Basic region leucine zipper
  misc_feature: GI Number: 9650828; NR Description: common plant regulatory
  misc_feature: GI Number: 16580130; NR Description: bZIP transcription
  misc_feature: GI Number: 24460973; NR Description: bZIP transcription
  misc_feature: GI Number: 4457221; NR Description: putative bZIP DNA-binding
  misc_feature: GI Number: 22597162; NR Description: bZIP transcription
CTCTTCTTAATCTCTCTGCTATTGGTTTCTTTGCAGGAATCAAAGCATATATTGTTTTGAAACTTGATGAGTGAAGTCCCTGGTTCCCGGTTTAGGTTTATGACCCACTTGGTTCAATCTTTCTCCGTTGTCTTCCTCTACTGGTTCTATGTTTTCTCGTTGATCTCCAGTTTCCCATCGCATATTATTATTATATAACTTAGTAATATAGTTATCAGTGTCTCTGGGTCCTGCGTCCTAATTAGGATTAGTTTATTTTATAATATGTCCATGTCCATGGCCTCATCAAGTGGAAACTCCTCTATTAGCACAAAATCTCAGAGCTCAGGGTCTGAGGGTGATTTGCAGGTCGTGATAACAGACGAGAGGAAGAACAAGAGGAAGCAATCGAATCGTGAATCGGCGAGAAGATCTCGGATGCGAAAGCGTAACCACTTGGACCAACTCACTAAGCAGCTCTCACAGCTCGCAAAGAACAACGGCGAAATCCTCGCCACCATAGACATCACCACGCAGCACTATCTGAACGTTGAGGCAGAGAATTCCATTCTAAGGGCCCAAATGGGTGAGCTTAGCCAACGGCTCCAATCGCTCAACGACATCGTCCACGACATCATCATCAACACAACCACCACCTACGAAAGGGACTGTTATCTAACAAGCGCACAAAATTTCACCACCACCACCTACACGCTCTGTCTTAACCAACCCGTTTTTCAGTGGTGAATTGTCACCCTCGTCCTCTGTGGATCTTGACCATAAAAGAAAGGAAAAGTGTGCGTCTGGGTGAATCTTCTCTTGGAGGAATCAATGTCAATCAGTGAAAAAAAATTAAGTTCATATTAGTACAGTACTTAGGGTGGGGCTATGTTAATTGTTAAACAGAATTTGCGCAAAGTGCTTATTGAAAATGACATAGTGGCCTGCAACTATATTTCAGATCAAAAAAAAAAAAAAAA

SEQ ID NO: 5347 - DNA, 1454 bp, Zea mays
  misc_feature (1)..(1454): Ceres cDNA ID no. 22005738
  misc_feature (1)..(1454): Ceres CLONE  ID no. 1276078
  misc_feature (1)..(1454): Also known as  Ceres CDNA ID no. 23835050
gaagccggacccctaatctgatgtgcacctgagttcgaagccgaattcacgactgcaattgcaaaaccctagctaccgcttcgccgaattccctgtcctccgcccgcttcgccgaattccctgtcctccgcccgcttcgccgaatttcctctcctccccgcccgccgcccgtcaccgcggcttcgtctgcgcttgtccctcccgttccaaggagcacgtgcttctcgccgcgccgttcgcccgccgccgccgccaccggttcatcgccagctatgtcttctcaggtcgacagccgcagccagtccgccgggaagcgcgcgcgcaccgacggcagccggcgtgaggacgactgggtttgccccagctgcaagaacgttaacttcgcctttcgcaccacttgcaacatgcgcaactgcaaccagtccaggccagcagatcacacggccatgcagaccccgcctcgctatcccacatcaggaggttacatgagcccagggacgccaccgtcgatgtaccttggtggtggtgctcccccatatggctcttcaatgtttaacgggcctgcaatgacgcgctatggtatcacacagttccctgggggttctgcgtatccatatggatatggtggccgcatatcaatggggagcccctacgggccaatgcaaatggctgggccaaccgcatactctggtggatctatgatgggagcaggtggaatgtatggaatgcccatggacaggtatgggctaatacctgctggttctggtccaatgggcacgagagctggctcatattctgatgaagattctcagaagaagtctgcaggagctggccgtgataatgattgggagtgtccaaattgccacaacatcaactttggcttccgcacagtctgtaatatgagaaagtgcaacacacctagacctgaaaaccagggatctaagcctgatggtttaagagggtcaaaaccaaagacaccagagggcagttggaagtgtgagcagtgcaataacataaactatcctttccgaacgaaatgcaatcgtccccaatgtggagcagaaaagccatcacagacgaacaatgcaaatgaatcagcggaagatcaggacaatcagtgagtcctagaacagtaatgagggtcaagaaggtccagcgtcgtcgtcaaggttcagtctgaatgtggggtacatctgtgtcagtagtcgccgttacaagtttcttccccttgagaacttagttgagtcggggccttggagttggcaatggagtcttgccttccttaatcactgcggataatggtcaagaacatcaatttgttatgtggtttgtcaagaacatccatcttgcctttcctggctgaacttggttacttgtctttgttactggtactctggataaattaccatatgttatatgaatgtcttttatatgtgtcaaaaaaaaaaaaaaaa

SEQ ID NO: 5348 - protein, 282 aa, Zea mays
  misc_feature: PFam Name: zf-RanBP; PFam Description: Zn-finger in Ran
  misc_feature: PFam Name: Keratin; PFam Description: Keratin
  misc_feature: PFam Name: GRP; PFam Description: Glycine rich protein family
  misc_feature: GI Number: 50947703; NR Description: p53 binding protein-like [Oryza sativa (japonica cultivar-group)] >gi|42407323|dbj|BAD08762.1| p53 binding protein-like [Oryza sativa (japonica cultivar-group)] >gi|42409183|dbj|BAD10449.1|
  misc_feature: GI Number: 50947701; NR Description: p53 binding protein-like [Oryza sativa (japonica cultivar-group)] >gi|42407324|dbj|BAD08763.1| p53 binding protein-like [Oryza sativa (japonica cultivar-group)] >gi|42409184|dbj|BAD10450.1|
  misc_feature: GI Number: 50947705; NR Description: p53 binding protein-like [Oryza sativa (japonica cultivar-group)] >gi|42407325|dbj|BAD08764.1| p53 binding protein-like [Oryza sativa (japonica cultivar-group)] >gi|42409185|dbj|BAD10451.1|
  misc_feature: GI Number: 25404955; NR Description: protein F1N21.14 [imported] - Arabidopsis thaliana >gi|9828626|gb|AAG00249.1|
  misc_feature: GI Number: 18698995; NR Description: p53 binding protein
MSSQVDSRSQSAGKRARTDGSRREDDWVCPSCKNVNFAFRTTCNMRNCNQSRPADHTAMQTPPRYPTSGGYMSPGTPPSMYLGGGAPPYGSSMFNGPAMTRYGITQFPGGSAYPYGYGGRISMGSPYGPMQMAGPTAYSGGSMMGAGGMYGMPMDRYGLIPAGSGPMGTRAGSYSDEDSQKKSAGAGRDNDWECPNCHNINFGFRTVCNMRKCNTPRPENQGSKPDGLRGSKPKTPEGSWKCEQCNNINYPFRTKCNRPQCGAEKPSQTNNANESAEDQDNQ

SEQ ID NO: 5349 - DNA, 1590 bp, Zea mays
  misc_feature (1)..(1590): Ceres cDNA ID no. 22005739
  misc_feature (1)..(1590): Ceres CLONE  ID no. 1276415
  misc_feature (1)..(1590): Also known as  Ceres CDNA ID no. 24726466
cttgcacaccagcagcaacaaaccacgcaacggctagtacggaagaagaggggcaagcggcgagcagcgccgttccgtcttcgccgtctcctcgtccgttcgccaagacaacggtcatattaccgttgtcctgccaaaattccaacactttaaaactgccacccaacgcgctcctccgccgccgtctccagcacacgcttccccttccctcccgctcccattcacgtcgtctctttcctcgagcctccgcttcgccagcgacgcgcccttctcacccacctcgccgaggaagtattcaccgatggagacgccgctgtcttccaggaggatcacccgctcgctcgccgccgcatctgcccagaagagcgccgccgccgggccggactccgccgccctcttctcccgcgccaagaacgccgccgctggggagacccagcctcgcgccgccctgcacgacatcaccaacgactcccccatcgtcgggctcgcggcgggcgccctccacgccaccgataccacccccgcctccaccgccgccaagacccgccgcagggccccgcgtcgcacgcccggctccggggaggcgctcctgcgcggccaggtcaaggcgctcctccacaaggtcgaagaggagcagggctgcgccgccgcggccctcgtcaggcccgcgcgcatccaggcgctgctcggtgtatccaggtcgccggcccagcttcttgcgccgacgccagccaacacgccgcagatcgagcccgtccccactcccagggaaggcctcctcctgcttgatggcgctagggtcatgccctgcgtcctagacgaagaggaactgctgattcctaagcttcaggtcattgcagcttccctacctccacctcatcaggcagaggagaagctcggggactgccagctgaaccgtgcgctggtgttcgatgactcccctgagaaatgtgaagagtccagtggatcagccgtctcgtcaaccttctccctccaggagagcagcaccggcagctacgtggacaagtcatcatcacctgaggacgacagctcctctgcctggtccattcaggtccatgccagctctgagaagggcgacgaagaagagctgggcgtggaggagctggcagcagagtacactgacgaagaggaggaggaggaggactgggacgaagacagcgatgacgactgctacgatgatctgtgcgaggagatgagcaggatgaccgtgttggaggaggaggagaagaagaagaccgtgctgccgcagttcgaggggaagcacaccaggttcatctacaacagtgacgacgagatcgagcgggtagaggaggcggatgcagctgaggcgacggcggagcttcgcgcattgatgctcaggggcctgctggtgccggaggggaggcacctgcgcttccacgacgaggatgccgacgaataagaatctcagttgtgttgtcaagtggttggttgtctttcgctgacaccagccaaaattcttttgcggggctctgagtccagttctgtacgttgattcattctccgttcttaagagaaataatccaacttttctgaaaaaaaaaaaaaaaa

SEQ ID NO: 5350 - protein, 379 aa, Zea mays
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: LMBR1; PFam Description: LMBR1-like membrane protein
  misc_feature: PFam Name: Drf_FH1; PFam Description: Formin Homology Region 1
  misc_feature: GI Number: 55238762; NR Description: ENSANGP00000010844
  misc_feature: GI Number: 12018147; NR Description: vegetative cell wall protein gp1 [Chlamydomonas reinhardtii] >gi|20138131|sp|Q9FPQ6|GP1_CHLRE Vegetative cell wall protein gp1
  misc_feature: GI Number: 34894166; NR Description: P0439B06.4 [Oryza sativa
  misc_feature: GI Number: 34525762; NR Description: erythrocyte membrane
  misc_feature: GI Number: 21992; NR Description: extensin [Volvox carteri]
METPLSSRRITRSLAAASAQKSAAAGPDSAALFSRAKNAAAGETQPRAALHDITNDSPIVGLAAGALHATDTTPASTAAKTRRRAPRRTPGSGEALLRGQVKALLHKVEEEQGCAAAALVRPARIQALLGVSRSPAQLLAPTPANTPQIEPVPTPREGLLLLDGARVMPCVLDEEELLIPKLQVIAASLPPPHQAEEKLGDCQLNRALVFDDSPEKCEESSGSAVSSTFSLQESSTGSYVDKSSSPEDDSSSAWSIQVHASSEKGDEEELGVEELAAEYTDEEEEEEDWDEDSDDDCYDDLCEEMSRMTVLEEEEKKKTVLPQFEGKHTRFIYNSDDEIERVEEADAAEATAELRALMLRGLLVPEGRHLRFHDEDADE

SEQ ID NO: 5351 - DNA, 756 bp, Zea mays
  misc_feature (1)..(756): Ceres cDNA ID no. 22005740
  misc_feature (1)..(756): Ceres CLONE  ID no. 1276512
  misc_feature (1)..(756): Also known as  Ceres CDNA ID no. 23835058
aaattcccaatcccaaccccaagtcacactccacctccgcaaccaaacgcgctagggtttccgcaccgcacctctagtcctccacccaccccaccccactaccggcgatggccaccgcggcggcacagggcggtagcgacaagccggcgctccggaagcccgtcttcaccaaggtcgaccagctcaagccgggcactaacgggcacaccctcaccgtcaaggtcgtcagcgccacccccgtgccgggccgcgcgcgcccgggcgcacccgccgccgcctcgtcccgcgcgccgcgcatcgccgagtgcctcgtcggagacgagaccggcgtcatcgtattcaccgcccgcaacgaccaagttgatttgctgaagcccgatgccacggtgatcttgcgcaatgccaaaatcgacatgttcaaaggatcaatgaggcttgcagtggacaaatgggggcggattgaggctacagagccagccagcttcacagtgaaggaagacaacaacttgtcccttgtagagtatgaattggttaacgtggctgaataaccgtcgaagcgtttctgcccccctttcttctttttcacgcacgccataagatgataagaaaacgaacagcatctcgaagctgagtttatttgttacggtggtcgataaggtcaaggcttctgctgttacacctttggatccaatccattaagatgaattacccttgcatctattgtaattgtgtggttatccaaaaaaaaaaaaaaaa

SEQ ID NO: 5352 - protein, 146 aa, Zea mays
  misc_feature: PFam Name: tRNA_anti; PFam Description: OB-fold nucleic acid
  misc_feature: PFam Name: Mito_carr; PFam Description: Mitochondrial
  misc_feature: GI Number: 34904470; NR Description: OSJNBa0086P08.14 [Oryza sativa (japonica cultivar-group)] >gi|11034703|dbj|BAB17204.1|
  misc_feature: GI Number: 34909622; NR Description: P0435B05.31 [Oryza sativa (japonica cultivar-group)] >gi|20160605|dbj|BAB89552.1| P0435B05.31 [Oryza sativa (japonica cultivar-group)] >gi|20160745|dbj|BAB89686.1| P0503C12.10 [Oryza sativa (japonica
  misc_feature: GI Number: 57900332; NR Description: DNA-binding protein-related-like [Oryza sativa (japonica cultivar-group)] gi|57899617|dbj|BAD87196.1| DNA-binding protein-related-like [Oryza
  misc_feature: GI Number: 5091555; NR Description: T10O24.24 [Arabidopsis thaliana] >gi|30681801|ref|NP_849633.1| DNA-binding protein-related
  misc_feature: GI Number: 6573753; NR Description: F20B24.1 [Arabidopsis thaliana]
MATAAAQGGSDKPALRKPVFTKVDQLKPGTNGHTLTVKVVSATPVPGRARPGAPAAASSRAPRIAECLVGDETGVIVFTARNDQVDLLKPDATVILRNAKIDMFKGSMRLAVDKWGRIEATEPASFTVKEDNNLSLVEYELVNVAE

SEQ ID NO: 5353 - DNA, 649 bp, Zea mays
  misc_feature (1)..(649): Ceres cDNA ID no. 22005741
  misc_feature (1)..(649): Ceres CLONE  ID no. 1277257
  misc_feature (1)..(649): Also known as  Ceres CDNA ID no. 22005741
gctcccccaaattcgtttgtttcccacggcgcaagaaagaaacaagggtacaagaacagcccgctaaaggaaagaaacaagggctacacaagaacagcttgagagctcctctccgatcccgacccaccgcctgcaactcttcttctctcctacgtgttcgtcagcccgctaagtgttaagatggcttcaagtgatggtcaaacagaagctgcggccccatctgtccccaaaaaccctgctatggcatcatgccggaagaagaaaacagatgatgctaccttcctcgaagatctgaaagaccacatcgatgagttcatccatgcctccatggatgagcacaagacctgctttaagaagacgatccagaagatgtttgggatgtcgaaggctgttgcagagagatccgcggcagaagcgaaggaagctggagttgaaagtgctttgccacttcagaccagtgtctcgcagtagaatttcacgttggtagtttcttgcttgacgccggcctttttttatacaagggttttgttgctctgtgttgtctgaaacgtataagcgtctcagtggcatgttttcataactgtattgtagtgctttcatcattctccgaagtttgttgtgtgagtatgccttaaaaaaaaaaaaaaaa

SEQ ID NO: 5354 - protein, 96 aa, Zea mays
MASSDGQTEAAAPSVPKNPAMASCRKKKTDDATFLEDLKDHIDEFIHASMDEHKTCFKKTIQKMFGMSKAVAERSAAEAKEAGVESALPLQTSVSQ

SEQ ID NO: 5355 - DNA, 1073 bp, Zea mays
  misc_feature (1)..(1073): Ceres cDNA ID no. 22005742
  misc_feature (1)..(1073): Ceres CLONE  ID no. 1279638
  misc_feature (1)..(1073): Also known as  Ceres CDNA ID no. 23833168
attcgatccgttcccttgccctaagacccacccctgatttcatttccccaatcatggcggcggctctgtcggggacggcggtgtccacggcagcgcttctagccccaatccgagctccaaccagcgcgtttatccggcgctcccagctcacctgtcatcgcctccactcactaaaatgccgccgcgctgggcccatcgtccccgcggccgctgctgccgcggcgggcagcagctcgccgtcgtcagccgttttccacggcgagtgcttcgtggtgggcgacaatatcgacaccgaccagatcatccccgccgagcacctcactctggtgccctccaagccggacgagtaccgcaagctcggttccttcgccttcgcggggctcccatccgcggcctacccgacgccgttcgtcgctccgggtgaggagtcctcccgctacgccatcattgtcggcggagccaacttcgggtgcggttcctctcgcgagcacgcgcccgtcgcgcttggggccgctggcgcacgcgccattgttgcggagggctacgcgcgcatcttttttcgcaactccgtggccactggggaagtgtaccctctggagctcacggacgttggggcctggaaggagtgcaagacaggggatgtggtcaccgtggaccttgctaactccgtttttattaaccacacctctggcaaggagtacaagctgaaaccaattggtgatgctggccctgtaattgaggccggagggatctttgcctacgcccggaagacaggaatgattgcgtcgaaagctgctgcatgagggaaagatcagcttaggcagccgagcctctgcggagatgaagaagtaagctggagttaggactaagagttactgcacctacttgatgtcgacggtgtctcaaaataagttgcggcctaccgaaattatgatgaatcaatcaatttggtctttgtcacagatcgtttttttttgtttgttactagtacttgtacaattgtactcctgcctgctactgtccttatctgtttgaataactgctgtgttgccatcttaaaaaaaaaaaaaaaa

SEQ ID NO: 5356 - protein, 249 aa, Zea mays
  misc_feature: PFam Name: Aconitase_C; PFam Description: Aconitase
  misc_feature: GI Number: 51979330; NR Description: PREDICTED OJ1003_B06.26 gene product [Oryza sativa (japonica cultivar-group)] >gi|51979326|ref|XP_507517.1| PREDICTED OJ1003_B06.26 gene product [Oryza sativa (japonica cultivar-group)] [Oryza sativa
  misc_feature: GI Number: 21673448; NR Description: 3-isopropylmalate dehydratase, small subunit, putative [Chlorobium tepidum TLS] >gi|21646551|gb|AAM71855.1| 3-isopropylmalate dehydratase, small
  misc_feature: GI Number: 21436289; NR Description: putative 3-isopropylmalate dehydratase small subunit [Arabidopsis thaliana] >gi|17380708|gb|AAL36184.1| putative 3-isopropylmalate dehydratase small subunit [Arabidopsis thaliana] subunit
  misc_feature: GI Number: 48891227; NR Description: COG0066: 3-isopropylmalate dehydratase small subunit [Trichodesmium
  misc_feature: GI Number: 51209877; NR Description: 3-isopropylmalate dehydratase small subunit [Gracilaria tenuistipitata var. liui] >gi|50657631|gb|AAT79616.1| 3-isopropylmalate dehydratase small
MAAALSGTAVSTAALLAPIRAPTSAFIRRSQLTCHRLHSLKCRRAGPIVPAAAAAAAGSSSPSSAVFHGECFVVGDNIDTDQIIPAEHLTLVPSKPDEYRKLGSFAFAGLPSAAYPTPFVAPGEESSRYAIIVGGANFGCGSSREHAPVALGAAGARAIVAEGYARIFFRNSVATGEVYPLELTDVGAWKECKTGDVVTVDLANSVFINHTSGKEYKLKPIGDAGPVIEAGGIFAYARKTGMIASKAAA

SEQ ID NO: 5357 - DNA, 700 bp, Zea mays
  misc_feature (1)..(700): Ceres cDNA ID no. 22005743
  misc_feature (1)..(700): Ceres CLONE  ID no. 1280405
  misc_feature (1)..(700): Also known as  Ceres CDNA ID no. 24364947
aggtacttgttgttgagcgcggagagaggagaggcgcagagcatcgacgatggcgagcggcagcatgaagagggagatcagcgagacccacgacaccctccgcttcggcctcaatgccggcgtcaaggccgacctcgcgccgccgcacccgctccagtccagcatccaatcggaggccaagttctgggcggacaagaagaagtttgggacagaggccatctacggatccgccttgaacatccgcaaggatctcgatgcccaaatcctctcaaggttccaaaggccccctggtgctttgccatcatctctgcttggatatgaggcactgacaggttccctagatgattttggttttgaagattatcttaacatgcctcaagattctgaaggtttccgtcaacctgacatgcaccacggaatggaggttcgccttggtttgtccaagggacctatctgccctagcttcagttgaggcagtgaatgtagttctgcggttctgccgcacgttgatgcaccttagtccagtacactcgggtcaataaaagaccacattaggatggtgaaacggtgaaaactgatggcttgcatatgttcagagtgttatgttgtaatgaacagtgttatgttgtaatgaacgcatatatcgcatgattgatagcttggctagctgtgcgcaggcttaaaaaaaaaaaaaaaaaaa

SEQ ID NO: 5358 - protein, 140 aa, Zea mays
  misc_feature: PFam Name: UMP1; PFam Description: Proteasome maturation
  misc_feature: GI Number: 51090706; NR Description: proteasome maturation
  misc_feature: GI Number: 50901266; NR Description: putative proteasome maturation factor [Oryza sativa (japonica cultivar-group)] >gi|41469323|gb|AAS07179.1| putative proteasome maturation factor
  misc_feature: GI Number: 9828633; NR Description: F1N21.7 [Arabidopsis thaliana]
  misc_feature: GI Number: 50726391; NR Description: proteasome maturation factor-like protein [Oryza sativa (japonica cultivar-group)] gi|51091632|dbj|BAD36401.1| proteasome maturation factor-like
  misc_feature: GI Number: 6049100; NR Description: unknown [Picea abies]
MASGSMKREISETHDTLRFGLNAGVKADLAPPHPLQSSIQSEAKFWADKKKFGTEAIYGSALNIRKDLDAQILSRFQRPPGALPSSLLGYEALTGSLDDFGFEDYLNMPQDSEGFRQPDMHHGMEVRLGLSKGPICPSFS

SEQ ID NO: 5359 - DNA, 1332 bp, Zea mays
  misc_feature (1)..(1332): Ceres cDNA ID no. 22005744
  misc_feature (1)..(1332): Ceres CLONE  ID no. 1281604
  misc_feature (1)..(1332): Also known as  Ceres CDNA ID no. 24396918
cattatccacattctttccagctagctcctgagattacttgcaaaacattcttgttgtttgctctagctagctgctgcaccatatatagaactatcgatctgagccattatattgttggcatttgtgctcgatcgacgtcgtcgtcgtcgtcccatggcgactaataagccttttgcagttaataagctgctgccagttgtggccctcctgctcctcctcgcagcatgtagctcaccggtggtggtggctcagctggtcgccggctactacagcaaaacatgcccggacgtcgaggagatcgtccgcgacgagatggagaagatcatctcggctgcacccagccttgctggcccgctcctcaggctgcatttccacgactgcttcgtcaggggctgtgacgcctctgtgctgctcaactctacggagggcaacctggcggagagggacgcgaagccgaacaagagcctccggggattcggttccgtggagagggtgaaggccaggctggaggccgcctgccccggcaccgtttcctgcgcggacgtcctcaccctcatggcccgcgacgccgtcgtgcttgccaaggggccattctggccagtcgcgctggggaggagagacggccgtgcgtccagcgcgacggaggcggccgaccatctgcctccagcttacggagacgtgcccctgctcaccaggatcttctcttccaagggcctcggcgtcaaggacctcgccgtcctctccggcgcccacacgctaggcacggcgcactgcccctcctacgccgaccgcctctacaacttcagcagcgcctacgactcggacccgtccctcgacaccgcgtacgccgaccggctcaggtcgcgctgcaagagcgtccaccacgacgacaaggacaaggccattctgtccgagatggatcccggcagctacaagaccttcgacaccagctactaccgacacgtcgccaagcgccgggggctcttccagtccgacgccgcgctcctcgccgacgccaccactagggagtacgtccaccgtattgccaccggcaagtttgacgacgtgttcttcaacgacttcgccgagtccatgaccaagatggccaacgtcgacgtgctcaccggtgccgagggggagatcaggaagaaatgctacatcgtcaactaaagtatacatgtattatcagctagctaaatcattattgttgttttaatgagtttaactccgtccactagatgatagggcgtgtgtctgcctgttattaatcaatgtaatgtatgtactcctattttgctgtaaattcattcttatcaaaaaaaaaaaaaaaa

SEQ ID NO: 5360 - protein, 338 aa, Zea mays
  misc_feature: PFam Name: peroxidase; PFam Description: Peroxidase
  misc_feature: PFam Name: Mucin; PFam Description: Mucin-like glycoprotein
  misc_feature: PFam Name: Pyr_redox_2; PFam Description: Pyridine
  misc_feature: PFam Name: Podocalyxin; PFam Description: Podocalyxin
  misc_feature: PFam Name: FH2; PFam Description: Formin Homology 2 Domain
  misc_feature: GI Number: 55701023; NR Description: TPA: class III peroxidase 78 precursor [Oryza sativa (japonica cultivar-group)] gi|54290729|dbj|BAD62399.1| putative peroxidase 1 precursor [Oryza
  misc_feature: GI Number: 52076453; NR Description: putative Peroxidase 1
  misc_feature: GI Number: 55701027; NR Description: TPA: class III
  misc_feature: GI Number: 55701135; NR Description: TPA: class III
  misc_feature: GI Number: 51038054; NR Description: peroxidase [Oryza sativa
MATNKPFAVNKLLPVVALLLLLAACSSPVVVAQLVAGYYSKTCPDVEEIVRDEMEKIISAAPSLAGPLLRLHFHDCFVRGCDASVLLNSTEGNLAERDAKPNKSLRGFGSVERVKARLEAACPGTVSCADVLTLMARDAVVLAKGPFWPVALGRRDGRASSATEAADHLPPAYGDVPLLTRIFSSKGLGVKDLAVLSGAHTLGTAHCPSYADRLYNFSSAYDSDPSLDTAYADRLRSRCKSVHHDDKDKAILSEMDPGSYKTFDTSYYRHVAKRRGLFQSDAALLADATTREYVHRIATGKFDDVFFNDFAESMTKMANVDVLTGAEGEIRKKCYIVN

SEQ ID NO: 5361 - DNA, 1858 bp, Zea mays
  misc_feature (1)..(1858): Ceres cDNA ID no. 22005745
  misc_feature (1)..(1858): Ceres CLONE  ID no. 1287031
  misc_feature (1)..(1858): Also known as  Ceres CDNA ID no. 24396788
accaccaatcaatcaggcgctggagtgacagcggcggcaacaccacgcccacgcggctgccggagccgaccccccgatggatctcccgccgctctcccaccaagcgctcttcgccgccgtccgatccgccgacgcggccgccgtccgcgcgctcctggccgacgccgaggcgtcgggcacctccctggccgcgctcgccgccgcgcagacggacgcgggggagaccgcgctgtacgtcgccgcggaggccggcagcgaggagaccgtgagcctcctcctcccgctctacgacctcgaggccgccaccgtccgctcacgcctcgatctcgacgccttccatgtcgccgccaagcagggccacaccggggttgtgaaagagtttttggggcggtggccagggctttgctcagtctgtgactcttccaacactagccccctctactccgctgctgtcaaggatcacttggatgtggtaaatgctatactggacactgatgatagctgcataaggattgtgcggaaaaacgggaagacatccctacatactgctgcaaggattggataccatcgtattgtcaaggcactcatagagagggatccaggaattgttccgatcaaggataggaagggacaaactgcacttcacatggctgtgaaaggcaagaacacagatgtagtggaagagttactgatggctgatgtttccattctcaatgtgcgggacaagaagggaaatactgctttgcacatagctacacggaaatggaggccccagatggtacagcttcttcttagctacgaatcacttgaaattaatgctatcaatattcaaaatgaaacagctatggatttggctgacaaagttccttatggtgagtctaaaacggaaataatagagtggttgacagaggctggtgcaaagaatgccagaaatgtggggaaaattgatgaggcatcagaactgaggagaactgtgagtgatatcaagcacaatgttcaggcacagcttagcgagaatgctaagaccaataaacgagtgactgggattcgcaaagaattgcagaaactgcatagagaagctattcagaacaccatcaattcagtcaccatggtagcaaccctgattgcctccattgccttcgttgccatattcaatttgccaggtcaatacttccaagatgtgaatagcgggggagacattggtgaggctcaaatagccaagcttactggttttcgtgtcttctgccttctgaatgcaactgctctcttcatttccctcgcggtggtcgtcgtgcagatcaccttggttgcctgggaaactggtgcccagaagcaagttatcaagatcgtaaataagctcatgtggaccgcatgccttagcacaggtgcggcttttatctcactggcatatgttgtagttggcccgcagcatgcctggatggccttcacagtatcagccatcggaggtccgatcatgattggaaccctcctgttcctagcctatctgttgttgcgcccacggttcaagtttggcgaagacagacagcgccgcatcaagagggcaagcggcagcaagtccttctcctggtcactccatgatggtttttcagatctggaagccttctctgatcatgagaagaagatatatgccctgtaggaaggtgtaacagtaattactcttgcatgagaagaggcaattgggagagtgcaaatggttcgtgtatatatttggtttagctgttttaaccttttaggtctgtggtgagccgcagttggaccttctcgtgtactatatctaagaatgaagagctgcacctattatgaagtgcaagtatatgacctaaaaaaaaaaaaaaaa

SEQ ID NO: 5362 - protein, 526 aa, Zea mays
  misc_feature: PFam Name: Ribosomal_S4e; PFam Description: Ribosomal family S4e
  misc_feature: PFam Name: S4; PFam Description: S4 domain
  misc_feature: GI Number: 44894458; NR Description: ribosomal protein S4
  misc_feature: GI Number: 2345154; NR Description: ribsomal protein S4 [Zea
  misc_feature: GI Number: 23505827; NR Description: At5g58420/mqj2_10 [Arabidopsis thaliana] >gi|17979233|gb|AAL49933.1|
  misc_feature: GI Number: 17104537; NR Description: putative ribosomal protein S4 [Arabidopsis thaliana] >gi|14334916|gb|AAK59636.1| putative ribosomal protein S4 [Arabidopsis thaliana] >gi|21536498|gb|AAM60830.1| putative ribosomal protein S4
  misc_feature: GI Number: 457803; NR Description: ribosomal protein S4 [Solanum tuberosum] >gi|1173257|sp|P46300|RS4_SOLTU 40S ribosomal protein S4 >gi|1076674|pir||S47642 ribosomal protein S4, cytosolic
MDLPPLSHQALFAAVRSADAAAVRALLADAEASGTSLAALAAAQTDAGETALYVAAEAGSEETVSLLLPLYDLEAATVRSRLDLDAFHVAAKQGHTGVVKEFLGRWPGLCSVCDSSNTSPLYSAAVKDHLDVVNAILDTDDSCIRIVRKNGKTSLHTAARIGYHRIVKALIERDPGIVPIKDRKGQTALHMAVKGKNTDVVEELLMADVSILNVRDKKGNTALHIATRKWRPQMVQLLLSYESLEINAINIQNETAMDLADKVPYGESKTEIIEWLTEAGAKNARNVGKIDEASELRRTVSDIKHNVQAQLSENAKTNKRVTGIRKELQKLHREAIQNTINSVTMVATLIASIAFVAIFNLPGQYFQDVNSGGDIGEAQIAKLTGFRVFCLLNATALFISLAVVVVQITLVAWETGAQKQVIKIVNKLMWTACLSTGAAFISLAYVVVGPQHAWMAFTVSAIGGPIMIGTLLFLAYLLLRPRFKFGEDRQRRIKRASGSKSFSWSLHDGFSDLEAFSDHEKKIYAL

SEQ ID NO: 5363 - DNA, 622 bp, Zea mays
  misc_feature (1)..(622): Ceres cDNA ID no. 22005747
  misc_feature (1)..(622): Ceres CLONE  ID no. 1290172
  misc_feature (1)..(622): Also known as  Ceres CDNA ID no. 23834988
aggagatcgcgagactgttgaaaacatactcagaaatatggtggatgttcgtgatgttgctgacgctcttcttctggcttacgaaaagccagaagcgtctggacgatacatctgcagttcacatgcaataaaagttgctgatatgataaacatactgaagaccttgtatccatcttacccttatcccaaaaattttgtggaagatgatgtcaactctgtatacagctctgagaaactgcagaagctggggtggagcttcaagcctatagaggaatccctccgcgacactgttgaatcctacaaagcatttggcatcctgaattgaacatccagctacgactgttccatctgctgtttttgcctccgaactctttctgaataataatgtatgtaggcagtgaaacagcattgccagcaggttaatcctggcatcatgctggagcagcactgtagttctctctttttttttcatccccaatactatctagtggttcaggaccaaataagtaggccccgtgctgactggtttatggcttgtggcctattgtcgctgctaaaactagaagcgttcgtactatcttgcactgctgcacttgatttctcatcaaaaaaaaaaaaaaaa

SEQ ID NO: 5364 - protein, 95 aa, Zea mays
  misc_feature: PFam Name: Epimerase; PFam Description: NAD dependent
  misc_feature: GI Number: 51091030; NR Description: putative cinnamoyl-CoA
  misc_feature: GI Number: 51091033; NR Description: putative cinnamoyl-CoA
  misc_feature: GI Number: 23197694; NR Description: putative cinnamoyl-CoA reductase [Arabidopsis thaliana] >gi|21536817|gb|AAM61149.1| putative cinnamoyl-CoA reductase [Arabidopsis thaliana] >gi|21539439|gb|AAM53272.1| putative cinnamoyl-CoA reductase
  misc_feature: GI Number: 30984536; NR Description: At2g33600 [Arabidopsis thaliana] >gi|20260488|gb|AAM13142.1| putative cinnamoyl-CoA reductase [Arabidopsis thaliana] >gi|2459448|gb|AAB80683.1| putative cinnamoyl-CoA reductase [Arabidopsis thaliana]
  misc_feature: GI Number: 6554472; NR Description: putative cinnamoyl-CoA
MVDVRDVADALLLAYEKPEASGRYICSSHAIKVADMINILKTLYPSYPYPKNFVEDDVNSVYSSEKLQKLGWSFKPIEESLRDTVESYKAFGILN

SEQ ID NO: 5365 - DNA, 778 bp, Triticum aestivum
  misc_feature (1)..(778): Ceres cDNA ID no. 22005748
  misc_feature (1)..(778): Ceres CLONE  ID no. 1314142
  misc_feature (1)..(778): Also known as  Ceres CDNA ID no. 24410167
gcaataatgccacacttagggctaggtgcgtacggaatcgccctcctcgaatcctctgccgccggaaacgaggtcgccgcctacctcctccctctgcctccccacagccggcaaggagctccgagccccgaccccgcgcccccgtctccgtgccgccgccgtcgtcgatcactctgtgcagccgccgccggcctctgcacccgactccaacctgtgcccccgccgtcaacctcccctccaggcatccagcggcaagagtaaaggaatatgccttcactgcaaaaagctttacctccagaacttgctgataatgcactcagattattccgggagtgtttaaggagggcaaagttcattggtaatcagcaacacaacacagggcttctcgtttccatggtgaggcaacagttcaagaaaaacatgcatgagactgatcctgagaagatacagaagatgaaggacgatgcggcaaggggccttatcaatcacatcatatatgagtcggagaagatgacagggcgcaaattctcgggttaagacagttcagttcttggatgttcctttccttttttattctcggcatacactgtatgaataatatatgaccagctgatgcttcacctttttttttgcacttttactgcggttcttgatgtaattggcccgcacatgcttagcgctagctggtttggttgatctttaggtctcttccaagcgtggagatgaagatcttcaacaaattttaatgctccagtcagtgtgaaaaaaaaaaaaaaaa

SEQ ID NO: 5366 - protein, 89 aa, Triticum aestivum
MPSLQKALPPELADNALRLFRECLRRAKFIGNQQHNTGLLVSMVRQQFKKNMHETDPEKIQKMKDDAARGLINHIIYESEKMTGRKFSG

SEQ ID NO: 5367 - DNA, 1015 bp, Triticum aestivum
  misc_feature (1)..(1015): Ceres cDNA ID no. 22005749
  misc_feature (1)..(1015): Ceres CLONE  ID no. 1320940
  misc_feature (1)..(1015): Also known as  Ceres CDNA ID no. 24412467
aacccgccgacgacttcttccttctctcctcccctcttcataccaatctctcctcctctgccatggcgacgtcgacttcgcgcgaccgcggcggctacccgccggactcgacgcggctgcgcatcggcgacgacatcgcctgggcggacgtcggcggcgtgtacgaccgcgacgactccctcaaggagaacaccaaccccaagtgcctcctcaaggcccacaacccgagcgcgcccggccagcaccaccaccaccaccacaacggcgccgcgtcgcagcgcttctcggggaacctgaagcccacggcggcgcccatcatcggcctctccgggaagctcggccagggcggcgcgcggcggacccaccagcagcacccgcccgccatgttccccaagaaggccaagaccggcggcggcggccgcaacccgaggcccgccgtcccggaggacgagcccagctcccccaaggtctcgtgcatcgggaaggtgctctccgagcgcgagagggcgcggcgcaggcctcgcccgcccccctcggagcgccctccttccggctgctgccctgggctcggcttcctcatgcgccgcagccgctcgcggaagagtgccgtggagagcgtcgactggtccccgcctcccccgccaccggcggcgaggcggagggaggcgaaggcggccgagacggaggaggccgcgccggcgccggcgcccgggctgggaggggtcatgcggttcgcgtcggggaggcgggcggcggattggccggcccagatggaggtggacgaccgcgtggcgaaatccgggccgttgtagcgcgggcaggagatttaattttgctcttgggttgggtttggtttgtgatcgcttctgctgcttgttgttgccgtgctctaggtttagtaaatccgtgcgtgtttgtgtgtatatactgatagtattaattaggacaacacatttgtgtgatcatgatatggatttgaaaatcagacaaaattttgctaaaaaaaaaaaaaaaa

SEQ ID NO: 5368 - protein, 249 aa, Triticum aestivum
  misc_feature: PFam Name: APC_basic; PFam Description: APC basic domain
  misc_feature: PFam Name: Mucin; PFam Description: Mucin-like glycoprotein
  misc_feature: PFam Name: Pkinase; PFam Description: Protein kinase domain
  misc_feature: PFam Name: Peptidase_S8; PFam Description: Subtilase family
  misc_feature: PFam Name: Cation_efflux; PFam Description: Cation efflux family
  misc_feature: GI Number: 34908494; NR Description: P0489B03.23 [Oryza sativa (japonica cultivar-group)] >gi|20161653|dbj|BAB90572.1| P0489B03.23 [Oryza sativa (japonica cultivar-group)] >gi|20521249|dbj|BAB91765.1| P0679C12.17 [Oryza sativa (japonica
  misc_feature: GI Number: 7248459; NR Description: arabinogalactan protein
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 29611414; NR Description: synapsin 2A [Takifugu
  misc_feature: GI Number: 56283929; NR Description: CG3047-PA [Drosophila melanogaster] gi|55380421|gb|AAF50957.4| CG3047-PA [Drosophila
MATSTSRDRGGYPPDSTRLRIGDDIAWADVGGVYDRDDSLKENTNPKCLLKAHNPSAPGQHHHHHHNGAASQRFSGNLKPTAAPIIGLSGKLGQGGARRTHQQHPPAMFPKKAKTGGGGRNPRPAVPEDEPSSPKVSCIGKVLSERERARRRPRPPPSERPPSGCCPGLGFLMRRSRSRKSAVESVDWSPPPPPPAARRREAKAAETEEAAPAPAPGLGGVMRFASGRRAADWPAQMEVDDRVAKSGPL

SEQ ID NO: 5369 - DNA, 1837 bp, Zea mays
  misc_feature (1)..(1837): Ceres cDNA ID no. 22005752
  misc_feature (1)..(1837): Ceres CLONE  ID no. 1359137
  misc_feature (1)..(1837): Also known as  Ceres CDNA ID no. 24359591
atccaacggactgcacccaacatgcttgcgaacgtctgccggcggcggctcaccatccccctctccccaatcctcgccgccgccgccgccgccgccagcggcaagaatcccatccactccaaccacgcgcgcgccctcctctctcaaagctactactcgtccgcctttcaggcggcgcccgaccgcgagccctgccccactacggtctcctacctggtttcctgcggtgtctcccccgccgtcgccgccgctcgcaaggtccgcatccgggacacggaccgggccgacgcagttcgggccctcctgcgcaagtacggcttctccgaggcggatatcacccgcacggtgcgtttagacccgctgctgctcaccttcgatccagaccgcaccattcgccccaagctcgacttcttcgtctcgctcgggatccagccccgcttgctcgccaccgagccccacatcctcgcccgcagcctggaaaaacacatcataccctgcatcgagtttttccgcaccatccttcgtaccgatgacaacatccgcatcgccgtctcccgcgtgccccgcgcgctcatgaccgatatcgagagcaccatgcgccccgccgtcgaggcgttcctcagccacggtctctccatggaagccatcgccaagcttctcatgattcacatgggaatgatcaagacaccgccggagcgcatccgcgaggccttccatgacctcaaggcgctcggcctccgcgtcacggatacgggcttcctctacggcttccgcgtcatttgcagccttaggagggagactatggtgcgcaaggtggcggttttcaagagcttcggggtgtccgaatctgaccttttcagggcgttcaagacgcagcccaccatactgctcgtcggagatgagaccataaagaagaagttcaggtttttcttggatgtgatgaagcttgagatagctgatgtgatggcgcagccactgactctggcgttgagcttggagaagaatatcatgccaaggtgcgccgtgctgagcatattgatgaaggagggtaagcttaagcggacacagaagttgattccaccactgctttccaattctagggtcttctcggagaggtatgtgttgaggcatgctaaggatgtgcctgatgttgttaaggcatttgagggcaagattaaatttcaagggtttggggaatcagaggttaggacttctgtgccactgaatgactgaagcccaaaccccaggattctgaaatcatgcttatttgttagaggtaaggcagatcaatgcatgtttgcaattgtaatcttgttccattcatactcatagtgaaatgtctatttctggggccatgtcgaatgtcatggttttgcatttttatgatacccatgcatccaggaacatgtacgttgtgacgttctcagctgtggtcgatctggcatgtgtggcctgccagttcttaaatcatgctgtggttcatatgcttatgacccggatggatttgttcattttgaaactctgattatttgtactgctctgctgagtggaaatgctcatgttactggaagttctgtgattttcttctctccccaaatgtaatattcaccctatcgattttgttttggttagtgagagaactatgctgatgatgtgccagtcctccggatatgttatggtattttagtgtagttaaatctgatcacgtatggggaatctgaatatttgtgactggagtcaatctgattcttctgagatcaaatttgttctttgttagggaccatctttcatttcagacaaatttgttgtgaggcggaagtcaaaaaaaaaaaaaaaa

SEQ ID NO: 5370 - protein, 403 aa, Zea mays
  misc_feature: PFam Name: mTERF; PFam Description: mTERF
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Atrophin-1; PFam Description: Atrophin-1 family
  misc_feature: GI Number: 15218140; NR Description: mitochondrial transcription termination factor family protein / mTERF family
  misc_feature: GI Number: 25511650; NR Description: T22I11.2 protein - Arabidopsis thaliana >gi|8886986|gb|AAF80646.1| Contains similarity to F28O16.19 a putative translation initiation factor IF-2 gi|6143896 from Arabidopsis thaliana gb|AC010718. It is a
  misc_feature: GI Number: 62732917; NR Description: mTERF, putative [Oryza
  misc_feature: GI Number: 51536072; NR Description: mitochondrial transcription termination factor-like [Oryza sativa (japonica cultivar-group)] >gi|51535002|dbj|BAD37286.1| mitochondrial transcription termination factor-like [Oryza sativa (japonica
  misc_feature: GI Number: 21553423; NR Description: unknown [Arabidopsis thaliana]
MLANVCRRRLTIPLSPILAAAAAAASGKNPIHSNHARALLSQSYYSSAFQAAPDREPCPTTVSYLVSCGVSPAVAAARKVRIRDTDRADAVRALLRKYGFSEADITRTVRLDPLLLTFDPDRTIRPKLDFFVSLGIQPRLLATEPHILARSLEKHIIPCIEFFRTILRTDDNIRIAVSRVPRALMTDIESTMRPAVEAFLSHGLSMEAIAKLLMIHMGMIKTPPERIREAFHDLKALGLRVTDTGFLYGFRVICSLRRETMVRKVAVFKSFGVSESDLFRAFKTQPTILLVGDETIKKKFRFFLDVMKLEIADVMAQPLTLALSLEKNIMPRCAVLSILMKEGKLKRTQKLIPPLLSNSRVFSERYVLRHAKDVPDVVKAFEGKIKFQGFGESEVRTSVPLND

SEQ ID NO: 5371 - DNA, 788 bp, Zea mays
  misc_feature (1)..(788): Ceres cDNA ID no. 22005753
  misc_feature (1)..(788): Ceres CLONE  ID no. 1364147
  misc_feature (1)..(788): Also known as  Ceres CDNA ID no. 24371475
gaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagccaagcaggaaggcccccggcattgctagctgtacgtgtctgtgtgtgcatctgcagcagggtgcaggcaggggcccgtacgtacgtgtctctttctctctctcatcttgtcaccgtacctatctagagtgtgtgtgttcgtactaattaaaatgttcttgtcgtcgtcgtctgtgcatgcatgtaccatgtcgtcgtgcatgtctattatgtgtgtgtcgtcgtgtcgatcggtacgtatagatgcctgttgttagcatgtgtgtcattacctagtcgtgtgtagtgtatgtatgtgcttgccgggcaaaagttgcatctagctaaacagtagtattacttttgttaaaaaaaaaaaaaaaa

SEQ ID NO: 5372 - protein, 115 aa, Zea mays
  misc_feature: PFam Name: Tubulin; PFam Description: Tubulin/FtsZ family,
  misc_feature: GI Number: 49659780; NR Description: alpha 1 tubulin [Cynodon
  misc_feature: GI Number: 33089076; NR Description: alpha-tubulin
  misc_feature: GI Number: 33089078; NR Description: alpha-tubulin
  misc_feature: GI Number: 33089082; NR Description: alpha-tubulin
  misc_feature: GI Number: 33089080; NR Description: alpha-tubulin [Chilodonella uncinata] >gi|33089064|gb|AAP93565.1| alpha-tubulin
MAATSSKSSSSSSSAQRAAAALLVAAAVAVSVLVVGAAAVCDMSNEQFMSCQPAAAKTTDPPAAPSQACCDALAGADLKCLCGYKNSPWMGVYNIDPKRAMELPAKCGLATPPDC

SEQ ID NO: 5373 - DNA, 921 bp, Zea mays
  misc_feature (1)..(921): Ceres cDNA ID no. 22005754
  misc_feature (1)..(921): Ceres CLONE  ID no. 1366320
  misc_feature (1)..(921): Also known as  Ceres CDNA ID no. 24360994
ctgtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaaccggtaatgtattctggatctagcagctcatcatggggtcacctgaagcttcctcatcagatgaacttcctcgaggagttgcgccgtgcagtggacgctcatacagaatttgcgtcgcctgtcgtcacctggaactaatcgaagtcagcatctgcatcattatgcgttatgactaattttcgaagtcagcatctgcatcattatgcgttatgactaatttatggaaggcaggctgttcgccaggtctatgtatgatgtatcccatacacggatgatgtgccaaaaggctttcgtctgacctgcagctgcttctggaatctgcatctgtacaattgtaccattgttacccctggccttgtagctgcaaagcagtttgttgtaacaattaaatgaggcgccggatcctcacgccatcgaaagtttgaaacagcttggttgttgtatggtagttccaagacttggtgattataatgtgcgcattttctcaaaaaaaaaaaaaaaa

SEQ ID NO: 5374 - protein, 153 aa, Zea mays
  misc_feature: PFam Name: Thioredoxin; PFam Description: Thioredoxin
MSSSGPLPAGTHQTRNRAGNRRKSGDRADKANYSYNNDGEKSNVPSLKNLPPIVHHETFFSNVQNDYNQTGLVPLEGCSASEASQLLSDRWTAAINMYNDQTIDPSEKPVMYSGSSSSSWGHLKLPHQMNFLEELRRAVDAHTEFASPVVTWN

SEQ ID NO: 5375 - DNA, 746 bp, Zea mays
  misc_feature (1)..(746): Ceres cDNA ID no. 22005755
  misc_feature (1)..(746): Ceres CLONE  ID no. 1370117
  misc_feature (1)..(746): Also known as  Ceres CDNA ID no. 23849243
caccaccacacaagaagaggcccccagccagccagtccacagctctccactcgagaaacctccagtccagctccacccttcgtccagaggcacaccacacacaccatggctcccagcaagcttgcggtggtcgtcgccttgatagcgtcgctcctcctgctcaccaccagcaacaccaagcttggcctgttcgtgctcggccaggctgctccgggcgcctacccaccacgggctcctccgccgcaccagatcgtcgaccccgccaaagactgcgggggcgcgtgcgacgtgcggtgcggcgcgcactcgcgcaagaacatctgcacccgggcgtgcctcaagtgctgcggcgtctgccgctgcgtgccggcgggcacggccggcaaccagcagacctgcggcaagtgctacaccgactggaccacgcacggcaacaagaccaagtgcccgtgactccttgtccttgatgagagcagcatgagtccatgggcggcgggcgcgccactgcccacactggcgcgcacgttttgtatgatccgaccccgtcggcgtagatgtgcgagcctgtagctatctagcttagatgtacgaggttgatgtgctctgctgtttgtttgttgctagtacttctatagtgtatctttgtgttgatgttgatgggtctgtgttcttgtgtaaaaaaaaggtgtgcgatgcgtttcccgtagcagtaaaatccatctgggttggaccaaaaaaaaaaaaaa

SEQ ID NO: 5376 - protein, 115 aa, Zea mays
  misc_feature: PFam Name: Ribosomal_S12; PFam Description: Ribosomal protein S12
MAPSKLAVVVALIASLLLLTTSNTKLGLFVLGQAAPGAYPPRAPPPHQIVDPAKDCGGACDVRCGAHSRKNICTRACLKCCGVCRCVPAGTAGNQQTCGKCYTDWTTHGNKTKCP

SEQ ID NO: 5377 - DNA, 1009 bp, Glycine max
  misc_feature (1)..(1009): Ceres cDNA ID no. 22005756
  misc_feature (1)..(1009): Ceres CLONE  ID no. 1370853
  misc_feature (1)..(1009): Also known as  Ceres CDNA ID no. 24398646
attcactctccttcatctctctcgctttctctctctttctctggcctctctctctctctcagaatttacacacgatccaatgacaacgaccaacaacgtgaacggatgttttggagacacgaagctgaccaaagtgtttgtaggaggattggcttgggacactaacaaagaagcaatgcatgatcatttcatcaagtacggtgatatcttggaggcagtcatcatctccgacaaactcactcgccgttccaaaggctacggctttgtgactttcaaagatgcggaagccgcgaagagggcttgtgaagactcgactccgatcatcaatggccgccgtgccaactgcaatcttgcttccctcggtggccgccttcgtagatctcccaccgtggcctcccctcaacaaggatctaagcacgtgggtaggcccatgtcaggacatgtagggaacaatcaagctcaatggtactaccctgcgggattcgcacaccagcaacatcaacaacaccatcatcagaccattcctttctatgggtaccctccctcctatgtcgccctgaacatgaccttcaatcaaaaagttggatacgttggaggcacctatatgagcggatactatgcacaaccgcaaccacaatcgctaccactgccacaaccacaatattaccaccaccatcacatgtatggtggaggaagagtaatggttggggcaaacccgatgatgcctctctacactgtctatccttatcatcaatctcacgccatcggttttcctcaaccctcttatacgaaacccatatcaggtacagttggaggaggaggagatagcataatgaagaaggccataagttgatgggctacacaacaagttgttgaccaaacgattcagcccaagaatattcattttctccggctcacaatgtttatttttaatatagagacaaatcattgttaaattaattcctttacatttcataatttattcattaaaactaaaaaaaaaaaaaaa

SEQ ID NO: 5378 - protein, 257 aa, Glycine max
  misc_feature: PFam Name: RRM_1; PFam Description: RNA recognition motif.
  misc_feature: GI Number: 21536939; NR Description: RNA binding protein-like
  misc_feature: GI Number: 7258381; NR Description: RNA binding protein-like [Arabidopsis thaliana] >gi|11358791|pir||T47636 RNA binding protein-like - Arabidopsis thaliana >gi|15232579|ref|NP_191037.1| RNA recognition motif (RRM)-containing protein [Arabidopsis
  misc_feature: GI Number: 15010636; NR Description: At1g20880/F9H16_14
  misc_feature: GI Number: 23505939; NR Description: At1g20880/F9H16_14
  misc_feature: GI Number: 18394923; NR Description: RNA recognition motif
MTTTNNVNGCFGDTKLTKVFVGGLAWDTNKEAMHDHFIKYGDILEAVIISDKLTRRSKGYGFVTFKDAEAAKRACEDSTPIINGRRANCNLASLGGRLRRSPTVASPQQGSKHVGRPMSGHVGNNQAQWYYPAGFAHQQHQQHHHQTIPFYGYPPSYVALNMTFNQKVGYVGGTYMSGYYAQPQPQSLPLPQPQYYHHHHMYGGGRVMVGANPMMPLYTVYPYHQSHAIGFPQPSYTKPISGTVGGGGDSIMKKAIS

SEQ ID NO: 5379 - DNA, 705 bp, Zea mays
  misc_feature (1)..(705): Ceres cDNA ID no. 22005757
  misc_feature (1)..(705): Ceres CLONE  ID no. 1372300
  misc_feature (1)..(705): Also known as  Ceres CDNA ID no. 23849420
atgttctttggcaaacacacacacacacacatcgtttgctgttgcaacaaagctctacacgggaagacaggctgcttctttcttgcagtctctggtccagaagcctgaagaaatggcgtcacccaacgtcacattcctcgccttcttcgtggccctcgcactattggcgcttcacaccaccgacgcagcggcggcggcagaaaccttgcgccataggagcgacacatggtgcgtggccaagccgtcgacgcaggaggcggcgctgcggggcaacctggagttcgcctgctccgagagcgactgcggcgccatccagggcaccggcggctgcgcccagcccgacagcctgctgtcacgggcgtcggtggccatgaacgcctactaccaggcccgggggaggaactcgtggaactgcttcttcaacggcaccggcctaatcaccatcactgaccccagccttggcacctgcaaatatgcttgacacgacgggctgctctgctgctgctgtgctcaacggacgatgaataaggctgtaggggaatgatgcatcttttccttctctttgttttgttattgtgtctgtgtgagtgagcagggagtatccttgcagaaccaaccagtatcatgtctgagcactctagagagaactttcgtgcttttatttcccaaatacagttctactccacgccaaaaaaaaaaaaaaaa

SEQ ID NO: 5380 - protein, 122 aa, Zea mays
  misc_feature: PFam Name: X8; PFam Description: X8 domain
  misc_feature: GI Number: 18481707; NR Description: putative
  misc_feature: GI Number: 50940883; NR Description: beta-1,3-glucanase C-like protein [Oryza sativa (japonica cultivar-group)] >gi|46390798|dbj|BAD16304.1| beta-1,3-glucanase C-like protein
  misc_feature: GI Number: 48310514; NR Description: At2g43670 [Arabidopsis
  misc_feature: GI Number: 48310038; NR Description: At2g43670 [Arabidopsis thaliana] >gi|30689458|ref|NP_181895.2| glycosyl hydrolase family
  misc_feature: GI Number: 56784589; NR Description: putative beta-1,3-glucanase [Oryza sativa (japonica cultivar-group)] gi|56784550|dbj|BAD81597.1| putative beta-1,3-glucanase [Oryza
MASPNVTFLAFFVALALLALHTTDAAAAAETLRHRSDTWCVAKPSTQEAALRGNLEFACSESDCGAIQGTGGCAQPDSLLSRASVAMNAYYQARGRNSWNCFFNGTGLITITDPSLGTCKYA

SEQ ID NO: 5381 - DNA, 624 bp, Zea mays
  misc_feature (1)..(624): Ceres cDNA ID no. 22005758
  misc_feature (1)..(624): Ceres CLONE  ID no. 1375794
  misc_feature (1)..(624): Also known as  Ceres CDNA ID no. 23853109
tccttcatcaagattctctcaattctacccgacgcttcttcagattctctttgttatcagagagatcaaatcgatggcttccctcgattccgacgtcaccatggttcccgcaggagaatcctcaagcagcgtcgccccatcgtcgtcgtccaccaagaaggcgaagagattcgaagttaagaagtggagcgccgtggctctctgggcttgggatatcgttgttgataattgcgccatctgcagaaaccacatcatggatttgtgtattgaatgtcaggctaatcaggccagtgctacgagtgaggaatgcactgttgcttggggggtttgcaaccacgccttccactttcactgcatcagcagatggcttaagactcgtcaagtttgtccattggataacagtgagtgggagttccagaagtatggtcactaaacccaccagcaaatcatttggttggcgcatatgagatgctgatattgctcaaagttctttgttttttttcttttttctggttgtctcaaagttgtcaaaacagagattactctgttgatattactcttcactgaacctattatgttttgctttgagtgataccttcaatttcaagaaaaaaaaaaaaaaaa

SEQ ID NO: 5382 - protein, 119 aa, Zea mays
  misc_feature: PFam Name: zf-C3HC4; PFam Description: Zinc finger, C3HC4
  misc_feature: GI Number: 21592528; NR Description: ring-box protein-like [Arabidopsis thaliana] >gi|26451409|dbj|BAC42804.1| putative ring-box protein [Arabidopsis thaliana] >gi|21389679|gb|AAM48038.1| ring-box protein-like [Arabidopsis
  misc_feature: GI Number: 31747517; NR Description: ring box protein
  misc_feature: GI Number: 7543891; NR Description: ring-box protein-like [Arabidopsis thaliana] >gi|37537998|sp|Q9M2B0|RBXB_ARATH Putative RING-box protein 1b (RBX1b-At) (At-Rbx1;2) (RBX1-1) >gi|11281910|pir||T47341 ring-box protein-like - Arabidopsis
  misc_feature: GI Number: 50911983; NR Description: putative RING box protein 1 [Oryza sativa (japonica cultivar-group)] >gi|19387246|gb|AAL87158.1| putative ring box-1 protein [Oryza sativa (japonica cultivar-group)] >gi|41053167|dbj|BAD08109.1|
  misc_feature: GI Number: 48095046; NR Description: similar to
MASLDSDVTMVPAGESSSSVAPSSSSTKKAKRFEVKKWSAVALWAWDIVVDNCAICRNHIMDLCIECQANQASATSEECTVAWGVCNHAFHFHCISRWLKTRQVCPLDNSEWEFQKYGH

SEQ ID NO: 5383 - DNA, 1374 bp, Zea mays
  misc_feature (1)..(1374): Ceres cDNA ID no. 22005759
  misc_feature (1)..(1374): Ceres CLONE  ID no. 1376423
  misc_feature (1)..(1374): Also known as  Ceres CDNA ID no. 23857852
atcacaatttcaaacctctctctctctctctcttctccaattctcaatcaatcgaatcatggttgaaccggcgaataccgttggaatcccgttgaaccacactgcgctgctgaaggatgagctcgacatcgtgatccccacgatccgcaacctcgatttcctcgagatgtggagaccttttctccagccttaccatctcatcatcgtccaggacggagatccttccaagaccattgctgttcctgaagggttcgattacgagctttacaacaggaacgacattaaccgtatcctcggtcccaaagcttcgtgcatttccttcaaggactcggcttgtcgctgcttcggttacatggtgtctaagaagaagtacatcttcacaatcgacgacgattgcttcgttgctaaggatccatctggaaaagcagtgaacgcacttgagcaacacatcaagaaccttctctgcccatcttctccgtttttcttcaacaccttgtacgacccataccgtgaaggtgctgacttcgtccgtggataccctttcagtctccgtgagggtgtttccactgctgtctcccacggtctctggctcaacatccctgattacgatgccccaacccaacttgtgaagcctaaagaaaggaacacaaggtatgtggatgctgtaatgaccatcccaaagggaacacttttcccaatgtgtggtatgaacttagcctttgaccgtgatctcatcggtccggctatgtactttggtctcatgggtgatggtcagcctattggtcgctacgacgatatgtgggctggatggtgtgtcaaggtgatctgtgaccatttggggttaggagtgaagacaggtcttccctacatttaccacagcaaggcaagcaacccatttgtgaacctgaagaaggaatacaagggcattttctggcaggaggacatcattcctttcttccagagcgcaaagctctcgaaagaagctgtgacggttcaacaatgctacattgagctgtccaagatggtgaaggagaagctcagcgccattgatccttactttgacaagcttgctgatgctatggtcacctggattgaagcttgggatgagcttaacccggccaccaaagcttgagcagcagataaaaaaaaaaatcaccgcagttttggttattagcttaacctatctcatctatcttctttccttccccgttttttttctgactttccggtgattattcagttcgttttaaagttgccagagtttatttaaatagtgatggtgtgtagttctatttaagaccgatacaatgtatcctctgagctttttgtttcaataataaaatcatatatattccttgaaaaaaaaaaaaaaaa

SEQ ID NO: 5384 - protein, 357 aa, Zea mays
  misc_feature: PFam Name: RGP; PFam Description: Reversibly glycosylated
  misc_feature: GI Number: 21464559; NR Description: AT5g15650/F14F8_30 [Arabidopsis thaliana] >gi|9755610|emb|CAC01764.1| reversibly glycosylated polypeptide-2 (AtRGB) [Arabidopsis thaliana] >gi|14532444|gb|AAK63950.1| AT5g15650/F14F8_30 [Arabidopsis
  misc_feature: GI Number: 31711848; NR Description: At3g02230 [Arabidopsis thaliana] >gi|6041795|gb|AAF02115.1| reversibly glycosylated polypeptide-1 [Arabidopsis thaliana] >gi|27311607|gb|AAO00769.1| reversibly glycosylated polypeptide-1 glycosylated polypeptide-1
  misc_feature: GI Number: 19913103; NR Description: UDP-Glucose:protein transglucosylase [Solanum tuberosum] >gi|34582499|sp|Q8RU27|UPT2_SOLTU Alpha-1,4-glucan-protein synthase
  misc_feature: GI Number: 48478827; NR Description: UDP-glucose:protein
  misc_feature: GI Number: 4158221; NR Description: reversibly glycosylated
MVEPANTVGIPLNHTALLKDELDIVIPTIRNLDFLEMWRPFLQPYHLIIVQDGDPSKTIAVPEGFDYELYNRNDINRILGPKASCISFKDSACRCFGYMVSKKKYIFTIDDDCFVAKDPSGKAVNALEQHIKNLLCPSSPFFFNTLYDPYREGADFVRGYPFSLREGVSTAVSHGLWLNIPDYDAPTQLVKPKERNTRYVDAVMTIPKGTLFPMCGMNLAFDRDLIGPAMYFGLMGDGQPIGRYDDMWAGWCVKVICDHLGLGVKTGLPYIYHSKASNPFVNLKKEYKGIFWQEDIIPFFQSAKLSKEAVTVQQCYIELSKMVKEKLSAIDPYFDKLADAMVTWIEAWDELNPATKA

SEQ ID NO: 5385 - DNA, 932 bp, Zea mays
  misc_feature (1)..(932): Ceres cDNA ID no. 22005760
  misc_feature (1)..(932): Ceres CLONE  ID no. 1376913
  misc_feature (1)..(932): Also known as  Ceres CDNA ID no. 25891077
gattctagggttttcacactttcacagcaatcggcgagaacttcaacaaccacaaaatggcgacgcaaatcagcaagaagagaaagtttgtagctgacggtgtgttctacgctgagctgaacgaggtcttaaccagagagcttgcggaagatggttactctggtgtggaggttagggttactccaatgaggactgagatcatcatcagagccacacgtacccaaaatgttctcggtgagaagggaaggaggatcagagagttgacatctcttgtgcagaagagattcaggttccctcaagacagtgttgagctttacgctgagaaggttgccaacagaggtctctgcgccattgctcaggccgagtctctccgttacaagctcctcggtggtcttgctgtccgcagggcttgctatggtgtcttgagattcgtcatggagagtggtgctaagggttgtgaggtgattgtgagtggaaagctccgtgcagcacgtgccaagtccatgaaattcaaggacggttacatggtttcctctggtcaaccaaccaaggattacatcgactctgctgtcagacatgttcttcttagacagggtgtgcttggaatcaaggtgaaggtcatgcttgactgggaccctaagggaataaatggaccaaagacaccattgcctgatgttgtcatcatccatgctcccaaggaggaagacgtcaactctgcacctgctcaggtttctgctccggctgctcttgcaccagaagctcccctcactgccgtagactaccctgagatgatcccagtcgcctagaagaaactcttttttttactagtactctgtgatttcgcccttataacttttctgctttttgacagtttatagtttatcgttatctcatcttcgaatcagacaccgttctccaaaaaaaaaaaaaaa

SEQ ID NO: 5386 - protein, 249 aa, Zea mays
MATQISKKRKFVADGVFYAELNEVLTRELAEDGYSGVEVRVTPMRTEIIIRATRTQNVLGEKGRRIRELTSLVQKRFRFPQDSVELYAEKVANRGLCAIAQAESLRYKLLGGLAVRRACYGVLRFVMESGAKGCEVIVSGKLRAARAKSMKFKDGYMVSSGQPTKDYIDSAVRHVLLRQGVLGIKVKVMLDWDPKGINGPKTPLPDVVIIHAPKEEDVNSAPAQVSAPAALAPEAPLTAVDYPEMIPVA

SEQ ID NO: 5387 - DNA, 1428 bp, Zea mays
  misc_feature (1)..(1428): Ceres cDNA ID no. 22005761
  misc_feature (1)..(1428): Ceres CLONE  ID no. 1377017
  misc_feature (1)..(1428): Also known as  Ceres CDNA ID no. 24396911
attttctcgagaatattattcttttaatggattagaaaatcaatctacaactacaactaagcaggcgtagaatcactctttcgtcttcttcttcatcatcatctgcttcttattttttttctgattgaccttggggagattcgcttaaccttgtaataatggcgggaatagctatagttttagatctactcaataaatctcataacaaacacgctttccactcatcgtcttctctgtcttccgccgccgccgtatctgctttcgccagtgctcccttcgcgtctaggtttctcttcggttcctttgagcctcgagttgcgtattgtgacgcggcagctgcaatagacgatgattaccttgctgctatacgaaagatgtctgcggatactttgcagcttcagacgcctacatacattcctactagctctaaggtttacaatatccagccaaaaccactcttctccgccttcgagttcagggcacttgcgatgaccacagtgagatccctcctcatgttttatctgcctcttttggagcctaaaccggcttcagaggacgatgatgatttccttaacaatgccgcggaagaactccgtggcgcagacttgattgttcctcttaaaaagtctgtcaagcagattgcccgtgagaccactgttgtgactactcggagagtccttgaaaggctggctattagttatgtctcacagcgtatggcatggaagcttctaaaggatgtgccacaatctactttacgcaaggcttggagagggtggcccacacatgtatacatctataaagtcagccagacaactcttagaggacacttcctcggaattgcagcatcatggacagttcaagtaggaatagaaatctacagatgtgttaaccgttatgttaaacccaaacccgaagaagtagacgaggaacaagtggagatagcagagcaagccaaggatcttggaaacaaagtcgtgggtatcacagtaagatgtggtgcttctttagtattcgctgccattggagctggtatctgctcttgcctcatgcgtccctccactggacaatggatcggctgcgcgttgggggacttggctggtccgatggttgtttcgatttgcttgcagaagactcttcaagctgatggttaactttatatggggagattgaattcttcagctttttccatccaaaatgaaatcagaatgttgttttttctgaattttttcttatggtttttactgaaaccttggaagcgttttcatcaagacactcgaatgattcacaaattgtacctacttttgagaacatctgaataaggcaggtgtttatttttctctggatttaatgttaaattcgtatatttcttctttccactcttgtaagtataagatttaacatgttattttcttaaaaaaaaaaaaaaaa

SEQ ID NO: 5388 - protein, 330 aa, Zea mays
  misc_feature: GI Number: 21592482; NR Description: unknown [Arabidopsis thaliana]
MAGIAIVLDLLNKSHNKHAFHSSSSLSSAAAVSAFASAPFASRFLFGSFEPRVAYCDAAAAIDDDYLAAIRKMSADTLQLQTPTYIPTSSKVYNIQPKPLFSAFEFRALAMTTVRSLLMFYLPLLEPKPASEDDDDFLNNAAEELRGADLIVPLKKSVKQIARETTVVTTRRVLERLAISYVSQRMAWKLLKDVPQSTLRKAWRGWPTHVYIYKVSQTTLRGHFLGIAASWTVQVGIEIYRCVNRYVKPKPEEVDEEQVEIAEQAKDLGNKVVGITVRCGASLVFAAIGAGICSCLMRPSTGQWIGCALGDLAGPMVVSICLQKTLQADG

SEQ ID NO: 5389 - DNA, 1333 bp, Zea mays
  misc_feature (1)..(1333): Ceres cDNA ID no. 22005762
  misc_feature (1)..(1333): Ceres CLONE  ID no. 1377989
  misc_feature (1)..(1333): Also known as  Ceres CDNA ID no. 25891849
aagacctgttcttcagtttgctgagagagtgaactaacaattatggcgaagatgatgatgatgcaacagagccagccttctttatctctccttacttcttctgtctctgactttaatggcgctaagctccacttacaagtccagtacaagaggaaggttcaacagccaaaaggagcactctatgtatcagcctccagcgaaaagaagattctcataatgggtggcactcgattcatcggtatcttcttatccaggctccttgtcaaagaaggacatcaggttacgttgttcacaagaggtaaatctcctattgccaaacaactccctggcgaatctgaccaagactttgctgatttttcctccaagattcttcacttgaaaggagacagaaaggactatgactttgtgaagtcaagtctttcagctgaaggctttgatgttgtttatgatatcaacgggagggaggctgaagaagttgagcccatattagatgcacttcctaaactagaacagtacatctactgttcttcagctggtgtttacttgaaatctgatgtcttgccacactgtgaggtggatgcagttgacccaaagagcaggcacaaggggaagctggagactgagagcttactgcaatcaaaaggtgtaaactggacttccatacgccctgtctacatctacggtccgttgaactacaaccccgttgaagaatggttcttccaccgtctcaaagctggccgccctatcccagttccaaactctggaatccagatctcacagctcggtcacgttaaggacttggcaacagcctttctggccgtgcttggtaacgagaaagccagcagagagatattcaacatctcgggagagaagtacgtcacctttgatggcttagcaagagcttgcgcaaaggctggtgggtttccagagccagagattgttcactacaaccctaaagagtttgactttggaaagaagaaggctttccctttccgtgaccagcatttctttgcctcggtggagaaagcaaagcatgtgcttggatggaaaccagagttcgatttggtggagggtctcactgactcatacaaccttgatttcggtcgtggaactttcagaaaagaggcggatttcaccactgacgacatgattctaagcaagaaacttgttcttcaatagaaacatattgatttgtatggttgtgtgatctcacactgaagaacattcgcaagtttattgtcgtctcaaatgtattttggtttcggattgtgttcgacttcttctaagaagaggcggtctggctcttgaagtttacttaaaaaaaaaaaaaaaa

SEQ ID NO: 5390 - protein, 378 aa, Zea mays
MAKMMMMQQSQPSLSLLTSSVSDFNGAKLHLQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLARACAKAGGFPEPEIVHYNPKEFDFGKKKAFPFRDQHFFASVEKAKHVLGWKPEFDLVEGLTDSYNLDFGRGTFRKEADFTTDDMILSKKLVLQ

SEQ ID NO: 5391 - DNA, 1013 bp, Zea mays
  misc_feature (1)..(1013): Ceres cDNA ID no. 22005763
  misc_feature (1)..(1013): Ceres CLONE  ID no. 1379391
  misc_feature (1)..(1013): Also known as  Ceres CDNA ID no. 24373813
agacagataagtgtttcccagagagaagagagagagagagagacaagtctcaatggcgtctgtagcttcttcaaccactctcatctcctcctccgctagtgttctcccagccaccaagtcttcgcttcttccatctccctccctctctttccttccaaccctctcctctccttccccatccgcttctctccggctcgctcgtccctctcccctcacctcaatccgctcctcttctcgccggagcttcgctgtcaaggcccaaaccgatgatcttccattggttggaaacaaggcgcctgattttgaggcagaggctgtgttcgatcaggagttcatcaaggtcaagctctctgagtacattgggaagaagtatgtgattctctttttctaccccttggacttcactttcgtctgcccaacagagattactgccttcagtgaccggtatgcagaatttgagaagctgaacacagaagtgttaggtgtctctgttgatagtgtgttctcccaccttgcttgggttcaaaccgacagaaaatctggaggacttggtgatctcaactatccacttatatcagatgtcactaaatctatctcaaaatcttttggagtgctcatccatgatcagggaatagcgttgagagggcttttcataatagacaaggaaggagtgatccaacattcaaccatcaacaatcttggtattggccgaagtgttgatgagacaatgagaacccttcaggcattacagtacatccaggagaaccctgatgaagtctgccctgcaggatggaaaccaggggagaagtcaatgaaacctgaccccaagctcagcaaagagtatttctcagctatttagaaatatctacaaaacctttgttatatgtgagctgagtttttattttaaacgctgaacattcctttgtttgaatctccactttgtccccccagaatccttgaaacttcattttccattaataaaagtcttgttatctccaaaaaaaaaaaaaaaa

SEQ ID NO: 5392 - protein, 268 aa, Zea mays
  misc_feature: PFam Name: AhpC-TSA; PFam Description: AhpC/TSA family
  misc_feature: GI Number: 6002472; NR Description: 2Cys-peroxiredoxin
  misc_feature: GI Number: 6041816; NR Description: putative 2-cys peroxiredoxin [Arabidopsis thaliana] >gi|19310515|gb|AAL84991.1| AT3g11630/T19F11_3 [Arabidopsis thaliana] >gi|16930449|gb|AAL31910.1| AT3g11630/T19F11_3 [Arabidopsis
  misc_feature: GI Number: 21592588; NR Description: putative 2-cys peroxiredoxin BAS1 precursor (thiol-specific antioxidant protein)
  misc_feature: GI Number: 7242491; NR Description: 2-Cys peroxiredoxin
  misc_feature: GI Number: 1498247; NR Description: bas1 protein [Spinacia oleracea] >gi|3121825|sp|O24364|BAS1_SPIOL 2-cys peroxiredoxin BAS1, chloroplast precursor (Thiol-specific antioxidant protein)
MASVASSTTLISSSASVLPATKSSLLPSPSLSFLPTLSSPSPSASLRLARPSPLTSIRSSSRRSFAVKAQTDDLPLVGNKAPDFEAEAVFDQEFIKVKLSEYIGKKYVILFFYPLDFTFVCPTEITAFSDRYAEFEKLNTEVLGVSVDSVFSHLAWVQTDRKSGGLGDLNYPLISDVTKSISKSFGVLIHDQGIALRGLFIIDKEGVIQHSTINNLGIGRSVDETMRTLQALQYIQENPDEVCPAGWKPGEKSMKPDPKLSKEYFSAI

SEQ ID NO: 5393 - DNA, 929 bp, Zea mays
  misc_feature (1)..(929): Ceres cDNA ID no. 22005764
  misc_feature (1)..(929): Ceres CLONE  ID no. 1380385
  misc_feature (1)..(929): Also known as  Ceres CDNA ID no. 23854900
acatttaataatgatttcactcatcaatcaaacaaaaccttttgtatttgatttttggttcttctctctctctctctatcgattagatctctgaatacgaagatcataaaagttttctgaagacgactttgtcatgtttttgttcgattggttctatggaatcctggccacgctaggcttgtggcagaaagaggcgaagatcttgtttctaggtctcgacaatgccggaaaaacaactctgcttcacatgctcaaagacgagagattagttcagcaccagccaacacagcatcccacatctgaggaactgagcattggcaaaatcaagttcaaggcctttgacttgggtggccatcagattgcacgtagggtctggaaagactactatgccaaggttgatgctgttgtgtacctagttgatgcttacgacaaggagaggtttgtggagtcaaaaagagagcttgacgctcttctatctgatgaagcattagctagtgtcccttttcttatccttgggaacaagattgatattccttatgcagcctctgaagatgagctcaggtatcatttgggtctcaccaatttcactaccggtaaaagcaacgtgagtcttggagaatctggtgttcgtccccttgaggtcttcatgtgcagcatcgtccgcaaaatgggatatggtgagggcttcaagtggctgtcttactacatcaagtaggaaaccaaacaagcattggtgatttgcttcacggttttatgaatcagacatctcaaattttttcctctttgaaaagacaaactgtttctctcttgtagtttcctcttaaagttctaatactatatgttaagtctgatggcttacaactctaaaacaaaaatgtgattctgattgtgaagtagtaatcattattatttcaaaaaaaaaaaaaaaa

SEQ ID NO: 5394 - protein, 193 aa, Zea mays
  misc_feature: PFam Name: Arf; PFam Description: ADP-ribosylation factor family
  misc_feature: PFam Name: MMR_HSR1; PFam Description: GTPase of unknown function
  misc_feature: PFam Name: Ras; PFam Description: Ras family
  misc_feature: PFam Name: G-alpha; PFam Description: G-protein alpha subunit
  misc_feature: GI Number: 34894960; NR Description: putative GTP-binding protein [Oryza sativa (japonica cultivar-group)] >gi|15623923|dbj|BAB67979.1| putative small GTP-binding protein Bsar1a [Oryza sativa (japonica cultivar-group)] Bsar1a [Oryza
  misc_feature: GI Number: 2108347; NR Description: small GTP-binding protein Bsar1b [Brassica rapa] >gi|3334322|sp|O04267|SARB_BRACM GTP-binding
  misc_feature: GI Number: 2108345; NR Description: small GTP-binding protein Bsar1a [Brassica rapa] >gi|25294171|pir||T52094 small GTP-binding protein Bsar1a [imported] - turnip >gi|3334321|sp|O04266|SARA_BRACM
  misc_feature: GI Number: 21436475; NR Description: putative Sar1 GTP binding protein [Arabidopsis thaliana] >gi|17979297|gb|AAL49874.1| putative Sar1 GTP binding protein [Arabidopsis thaliana] >gi|15228793|ref|NP_191815.1| GTP-binding protein, putative
  misc_feature: GI Number: 1549222; NR Description: NtSar1 protein [Nicotiana
MFLFDWFYGILATLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDEALASVPFLILGNKIDIPYAASEDELRYHLGLTNFTTGKSNVSLGESGVRPLEVFMCSIVRKMGYGEGFKWLSYYIK

SEQ ID NO: 5395 - DNA, 1207 bp, Zea mays
  misc_feature (1)..(1207): Ceres cDNA ID no. 22005765
  misc_feature (1)..(1207): Ceres CLONE  ID no. 1380431
  misc_feature (1)..(1207): Also known as  Ceres CDNA ID no. 0
attcgcccgttcgaattctctcgcctcgacctcctcctcacctgcctgctcggctgctcgccagaccaaccacagccgtcggcgctgcagaccgcggcgggcaggatcagcggtgcgtagtctgcccatttcgcgaggaccatataattccaagaccctgatgatggccacaactgcttatatcgatgattcctgttcggaggttattgatcccccgaagactgaggtgctggatgttgctgaactccctggtgaccatactcagaacccaccaaaaccgaatgttgtggtgtctagcagtgtccgtgaacttctggaatgtccagtctgtttgagtgccatgtatcctcctattcatcagtgctctaatggtcatacattgtgttccggatgcaaaccaagggttcataatcgttgtccaacttgtaggcatgaactgggtaacataaggtgccttgctctcgagaaggtggctgcatctcttgaacttccatgcaagtaccagtgctttgggtgcccaggcatttatccttactacagcaagctgaagcatgagtcgcagtgccaatataggccttatagttgtccatatgctggatctgagtgcacagttgctggtgacattccatatttggtgaatcacttgaaagatgatcacaaagttgacatgcacaacggctgtaccttcaaccatcgctatgtaaagccaaaccctcatgaagttgagaacgccacctggatgcttacggtattcagctgctttggccaatacttctgcctacacttcgaggccttccagttgggcatgtcacccgtctacatcgccttcctgaggttcatgggagacgacgcggaagcgaagaactacagctacagcctggaggtagggggcacggggcgcaagatggtctggcagggggtgccccggagcatcagggacagccaccggaaggtccgggacagctacgacgggctcatcatccagaggaacatggccctgttcttctcgggtggcgacaggaaggagctcaagctgcgtgtcactgggcggatctggaaggaacaatgagcttgatgggtcagctagtacgtctgtcccgctccgctgctgccctgtactcatgaatcacatcgcaaagagcttttgccagtcgtaggaatgggcgactctgtggttcgttctgtgttttcaaaaaaaaaaaaaaaa

SEQ ID NO: 5396 - protein, 302 aa, Zea mays
MMATTAYIDDSCSEVIDPPKTEVLDVAELPGDHTQNPPKPNVVVSSSVRELLECPVCLSAMYPPIHQCSNGHTLCSGCKPRVHNRCPTCRHELGNIRCLALEKVAASLELPCKYQCFGCPGIYPYYSKLKHESQCQYRPYSCPYAGSECTVAGDIPYLVNHLKDDHKVDMHNGCTFNHRYVKPNPHEVENATWMLTVFSCFGQYFCLHFEAFQLGMSPVYIAFLRFMGDDAEAKNYSYSLEVGGTGRKMVWQGVPRSIRDSHRKVRDSYDGLIIQRNMALFFSGGDRKELKLRVTGRIWKEQ

SEQ ID NO: 5397 - DNA, 1283 bp, Zea mays
  misc_feature (1)..(1283): Ceres cDNA ID no. 22005766
  misc_feature (1)..(1283): Ceres CLONE  ID no. 1382608
  misc_feature (1)..(1283): Also known as  Ceres CDNA ID no. 25891080
atctatttatgacttctctcaaccagcaataacgaaaacgtctctcctctctatctctctttaaaaaaatggacggcgtagcattcttcttcaccggagctctcgtagccggcggaatctactggttcctgtgcgtcctgggaccagcggagcgaaaaggaaaacgagcgttggatctatcgggggggtccatctcggccgagaaagttcaagacaagtacaaacagtactggtcgttcttccgccgtccgaaagagatcgaaaccgccgagaaagtcccggacttcgtcgacacgttctacaacctcgtcaccgacatctacgagtggggatggggacagtccttccacttctctccttccatccgaggcaaatcccaccgcgacgccacgcgcctccacgaagagatggccgtagatctgatccaagtgaaaccgggtcaaaagatcctcgatgtcggatgcggcgtcggaggtccgatgcgcgcgattgcatcccactcgcgagccaacgtggtggggatcacgatcaacgagtaccaggtgaagagagcgcgtgaccacaacagaaaagcaggactcgacgcgctctgcgaggtcgtgtgtggtaacttcctccagatacccttcgatgataacaccttcgacggcgcgtactctatcgaagcgacgtgtcacgcgccgaagctggaagaagtctacgccgagatctacagggtgttgaaacccggatctttgtacgtatcgtacgagtgggtcaccactgataagttcaacgccgaggatgaggaacacgtggaggtcatccaaggcatcgagaggggtgacgcgcttcctgggcttagggcttactcggatatagccgaggccgccaagaaagttggcttccaagttgtcaaggagaaggatctagcggctccaccggctgagccgtggtggactaggcttaagatgggtcggctcgcttattggaggaaccacattgtggttcagattctgtctgctgttggagttgcgcctaagggaaccgtcgatgttcacgagatgttgtttaagactgctgatttcttgtccagaggaggcgaaactgaaattttctctccgatgcatatgattctctgccggaaacctatgtcttaaacgataatcatttcccgatctcagtttgtttttaattttttttcttatggatttttgattttgcctggtcagtcaatgtactcctttagattttaattttaatttggtattactgttttttcttgcctaaaaaaaaaaaaaaaa

SEQ ID NO: 5398 - protein, 356 aa, Zea mays
MDGVAFFFTGALVAGGIYWFLCVLGPAERKGKRALDLSGGSISAEKVQDKYKQYWSFFRRPKEIETAEKVPDFVDTFYNLVTDIYEWGWGQSFHFSPSIRGKSHRDATRLHEEMAVDLIQVKPGQKILDVGCGVGGPMRAIASHSRANVVGITINEYQVKRARDHNRKAGLDALCEVVCGNFLQIPFDDNTFDGAYSIEATCHAPKLEEVYAEIYRVLKPGSLYVSYEWVTTDKFNAEDEEHVEVIQGIERGDALPGLRAYSDIAEAAKKVGFQVVKEKDLAAPPAEPWWTRLKMGRLAYWRNHIVVQILSAVGVAPKGTVDVHEMLFKTADFLSRGGETEIFSPMHMILCRKPMS

SEQ ID NO: 5399 - DNA, 1040 bp, Zea mays
  misc_feature (1)..(1040): Ceres cDNA ID no. 22005767
  misc_feature (1)..(1040): Ceres CLONE  ID no. 1382639
  misc_feature (1)..(1040): Also known as  Ceres CDNA ID no. 23858237
ctctcggaaccctttggctcgatttgattacctctcttcactaaggtttaaaggatgaagcttgatactagtgggttcgagacatccatgcctacgattggattcgggtcgagcaacgatatgcttgatgggttttctactgtgccctcctttgaccttccccgcactactgatttcgatgggtttcagaaagaagcagtacagatggtgaagccagcgaaaggaacaacaacacttgctttcatcttcaaagaaggtgtcatggtcgctgctgattctcgtgctagcatgggtggatatatctcgtcacaatctgtgaagaagattattgaaatcaatccttatatgcttggtacaatggctggaggagcggctgattgtcaattctggcacagaaaccttggaatcaagtgccgtctacatgagctggcaaacaagaggagaatatctgtttccggagcttcaaaacttctagcaaacatgctctactcataccgtggaatgggactttccgtcggcacaatgattgctggatgggacgaaactggtcctggactatactatgtggacaacgaaggaggaaggctcaagggagacaggttttcagtcggttctggttcaccatacgcttatggtgtacttgacagcgggtacaaattcgatatgtcagttgaagaagcatctgagttagcaaggagatcaatctaccatgcgacattccgtgatggagctagtggtggagttgctagcgtgtaccacgtgggtcctaatggatggaagaaactgtcgggagatgatgttggggagctacactatcactactaccctgtgccaccatccactgccgaacaagtcatggaggaagcggctgccgagtaataacattcactctctagcttaaactttgtttctcactataagattctccttttattctgcaactgcacactctttattttgttcaagcagctctgtttcaaccatgaaattaggaccgatcaaatagaaccgatctatttcaaataaaaaaaaaaaaaaaa

SEQ ID NO: 5400 - protein, 274 aa, Zea mays
  misc_feature: PFam Name: Proteasome; PFam Description: Proteasome A-type
  misc_feature: GI Number: 21553804; NR Description: 26S proteasome beta subunit, putative [Arabidopsis thaliana] >gi|9294292|dbj|BAB02194.1| proteasome epsilon chain precursor [Arabidopsis thaliana] >gi|21928101|gb|AAM78079.1|
  misc_feature: GI Number: 15292875; NR Description: putative proteasome
  misc_feature: GI Number: 7435872; NR Description: 26S proteasome beta chain - spinach gi|2285800|dbj|BAA21650.1| 26S proteasome beta subunit [Spinacia oleracea] gi|3914430|sp|O24361|PSB5_SPIOL Proteasome subunit beta type 5 precursor (20S proteasome subunit E)
  misc_feature: GI Number: 55297435; NR Description: beta 5 subunit of 20S
  misc_feature: GI Number: 8671510; NR Description: beta 5 subunit of 20S
MKLDTSGFETSMPTIGFGSSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVPPSTAEQVMEEAAAE

SEQ ID NO: 5401 - DNA, 1328 bp, Zea mays
  misc_feature (1)..(1328): Ceres cDNA ID no. 22005768
  misc_feature (1)..(1328): Ceres CLONE  ID no. 1382645
  misc_feature (1)..(1328): Also known as  Ceres CDNA ID no. 24360831
ccggtcctccacactccactgtctctcacactcacacagtctcacaaaggctcgtgggctcgtggcctggcctctataaacccccgcccagccggtcacccccaccccatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcaacttcatctggtacggcgacttctcggcgccgcagcgggcggcgatcaccgacttcgtctcgtcgctgacggcggcggccccggccgcggcgcagccggagccgtccgtggccacgtggttcaagacggcgcgcaagtactacgccagctccaaggtgccgttcccggcgctgcgcctcggctcccacgccgtcgaccggaactgctccctcggcaggcgcctgacggagagggacctgctcaggctcgccgccaggggagccccgagccgcgccatcaacctggtgctcacggccgccgacgtggccgtggacgggttctgcgagtcccggtgcggcacgcacggcgcgtccccgcggtcccgctccggccggttcgcgtacgcgtgggtcggcaacccggcgtcgcagtgccccgggcagtgcgcgtggccgttccaccagcccgtgtacggcccgcaggcggcgccgctcaccccgcccaacggcgacgttggggtcgacggcatggtcatctcgctggcgtccatgctcgtcggcacggtcaccaacccgttcggcaacgggttctactaccaggagggctcggccgacgcgccgctggaggccgccacggcgtgcgccggcgtgtacggcaagggcgcgtaccccggctacgcgggctcgctgctggtagaccaggccagcggggccagcttcaatgccaacggggcccacgggaggaagtacctggtcccggcgctcgtcgacctggacacgtcgtcgtgcgccaccttggtttagatttcgctggtcgtaatcagtgttttgtggtggcgggtgctgtgcgtggagagtgttccacgcggctgacgattctagtagtgtagtgacctgtgaccatggtggattctttcatctgttcaatgaaaaaaaagaaatattttcacgcaaaaaaaaaaaaaaaa

SEQ ID NO: 5402 - protein, 314 aa, Zea mays
  misc_feature: PFam Name: Inositol_P; PFam Description: Inositol
  misc_feature: PFam Name: Extensin_2; PFam Description: Extensin-like region
  misc_feature: GI Number: 1109672; NR Description: 3'(2'),5-diphosphonucleoside 3'(2') phosphohydrolase >gi|7489522|pir||T03305 probable 3'(2'),5'-bisphosphate nucleotidase (EC 3.1.3.7) - rice >gi|3913517|sp|Q40639|DPNP_ORYSA
  misc_feature: GI Number: 14268820; NR Description: diphosphonucleotide
  misc_feature: GI Number: 20466007; NR Description: putative 3(2),5-bisphosphate nucleotidase [Arabidopsis thaliana] >gi|17979307|gb|AAL49879.1| putative 3(2),5-bisphosphate nucleotidase [Arabidopsis thaliana] >gi|8777313|dbj|BAA96903.1|
  misc_feature: GI Number: 28416675; NR Description: At5g09290 [Arabidopsis thaliana] >gi|34395640|sp|Q84VY5|DPN4_ARATH Probable SAL4 phosphatase (3'(2'),5'-bisphosphate nucleotidase 4) (3'(2'),5'-bisphosphonucleoside 3'(2')-phosphohydrolase 4)
  misc_feature: GI Number: 30017325; NR Description: At5g63990 [Arabidopsis thaliana] >gi|26450749|dbj|BAC42483.1| putative 3'(2'),5'-bisphosphate nucleotidase [Arabidopsis thaliana] >gi|34395669|sp|Q8GY63|DPN3_ARATH Probable SAL3 phosphatase
MACYNTASLAATLLAFALTFQACLAGRRLTALVQEPAITMRYHKGALLSGPIAVNFIWYGDFSAPQRAAITDFVSSLTAAAPAAAQPEPSVATWFKTARKYYASSKVPFPALRLGSHAVDRNCSLGRRLTERDLLRLAARGAPSRAINLVLTAADVAVDGFCESRCGTHGASPRSRSGRFAYAWVGNPASQCPGQCAWPFHQPVYGPQAAPLTPPNGDVGVDGMVISLASMLVGTVTNPFGNGFYYQEGSADAPLEAATACAGVYGKGAYPGYAGSLLVDQASGASFNANGAHGRKYLVPALVDLDTSSCATLV

SEQ ID NO: 5403 - DNA, 607 bp, Zea mays
  misc_feature (1)..(607): Ceres cDNA ID no. 22005769
  misc_feature (1)..(607): Ceres CLONE  ID no. 1384567
  misc_feature (1)..(607): Also known as  Ceres CDNA ID no. 23858256
attttcgtctctttcgcttttacatcacaaaaccgaagcgatgcagtcattgaccgtcgcagcagcgaagacgctacgaaaccggatcttctcccggtccggatccacatccgccgggccgagccgctgggccacgccgggccacgaggagcggcccaagggctacttcatgaaccgcacccctccgccgccgggacagtcgcgcaaatgggaggactgggagcttccttgctacatcacgagcttcctcacgatcgtcatcctcggcgtcgggctcaacgctaagcctgatctctcgatcgagacctgggctcatcagaaggccctggaacgcctccagatggagaggctcgcttcgtcagccggagattcttccgattgagcttcaccgcttgatctccggaaggtggattgtggcgatcaagaaggcttggagagagttagggctttctgaagaagtttgtttttggatatcgtttgtttagtcgataatgatgaaataagtgttatttaactgtttttgacgcattacatttctcaaagttgatcacttttgatacaacatctgcaatttgatttgctccttcgaagaaaaaaaaaaaaaaaa

SEQ ID NO: 5404 - protein, 113 aa, Zea mays
  misc_feature: GI Number: 9858777; NR Description: BAC19.9 [Lycopersicon
MQSLTVAAAKTLRNRIFSRSGSTSAGPSRWATPGHEERPKGYFMNRTPPPPGQSRKWEDWELPCYITSFLTIVILGVGLNAKPDLSIETWAHQKALERLQMERLASSAGDSSD

SEQ ID NO: 5405 - DNA, 1463 bp, Zea mays
  misc_feature (1)..(1463): Ceres cDNA ID no. 22005771
  misc_feature (1)..(1463): Ceres CLONE  ID no. 1387249
  misc_feature (1)..(1463): Also known as  Ceres CDNA ID no. 24373797
attttccacgccttcattctctctataagattcattttatagattccatggccaccgtctcctccgcttctccctggccaagcgtttccacctccgcctcagattcgaactctgctgttccctctcaccaccgcgatcgtggagacgagaccgagtctctcgattccttctcctccatgagcctcaactccgaagagattactcataattccgatcgaattccggagtctcaaacaccggcgaatcctcccccgtcgctgctccacctctccttcaaccaggaccacgcctgcttcgccgtcggcaccgaccgcggcttccggatcctcaactgcgatccgttccgcgaaatcttccggcgcgatttcgatcggggcggtggagtcgccgtcgtggagatgctcttcagatgcaatatcctagcgctcgtaggcggcggacctgatccgcagtatccgccgaacaaggtcatgatttgggacgatcaccagagccggtgcatcggcgagctctccttcaggtccgatgttcgatccgttaggctcaggagggatcggattatcgtggtcctcgagcagaagatttttgtttacaacttcgcggaccttaagctgatgcatcagattgagactattgcgaaccctaagggcttgtgcgctgtctctcagggtgctggctctatggtgttggtgtgtcctggtttgcagaaaggacaactgaggatcgagcattatgcttcgaagcggactaagttcgtcatggctcatgattcgaggattgcttgctttgctctcacgcaggatgggcatttgttggccacggctagctctaaggggactctggttcggatctttaatactgttgatggcaccttgcgccaagaggttaggaggggtgcagatagagcagagatatacagtctggctttctcttcaaatgctcagtggttagctgtctcaagtgacaaaggaaccgtccatgtctttggtctcaaaggcaactccggtgctcaggtgaaagacacacccagaattgcatctgatcttactcgtacttcctcatccccatcctcgtccctgtcattattcaaaggagtgttgcccaagtatttcagctcggagtggtcggtggctcagttccggttggttgaaggaactcagtacgtagtcgcctttggacatcagaagaatactgttgttattcttggcatggatgggagcttctacagatgccagtttgatccggtgaatgggggagaaatgtctcagcttgagtatcacaactgtctaaaacctcctgttttctagatgcaactattttcttaagttccttctatcttttatctctgctctacttaagtggtgagagtcggtgcaaccatatggtgttaatgtatatagtttgtgtgtataataattacgaatggttcttataatttccaaaaaccaaaaaaaaaaaaaaaa

SEQ ID NO: 5406 - protein, 419 aa, Zea mays
  misc_feature: PFam Name: WD40; PFam Description: WD domain, G-beta repeat
  misc_feature: GI Number: 16323362; NR Description: AT3g62770/F26K9_200 [Arabidopsis thaliana] >gi|14517420|gb|AAK62600.1|
  misc_feature: GI Number: 34907164; NR Description: P0423A12.19 [Oryza sativa (japonica cultivar-group)] >gi|21104657|dbj|BAB93248.1|
  misc_feature: GI Number: 18412493; NR Description: transport
  misc_feature: GI Number: 30694449; NR Description: WD-40 repeat protein
  misc_feature: GI Number: 62657512; NR Description: PREDICTED: similar to
MATVSSASPWPSVSTSASDSNSAVPSHHRDRGDETESLDSFSSMSLNSEEITHNSDRIPESQTPANPPPSLLHLSFNQDHACFAVGTDRGFRILNCDPFREIFRRDFDRGGGVAVVEMLFRCNILALVGGGPDPQYPPNKVMIWDDHQSRCIGELSFRSDVRSVRLRRDRIIVVLEQKIFVYNFADLKLMHQIETIANPKGLCAVSQGAGSMVLVCPGLQKGQLRIEHYASKRTKFVMAHDSRIACFALTQDGHLLATASSKGTLVRIFNTVDGTLRQEVRRGADRAEIYSLAFSSNAQWLAVSSDKGTVHVFGLKGNSGAQVKDTPRIASDLTRTSSSPSSSLSLFKGVLPKYFSSEWSVAQFRLVEGTQYVVAFGHQKNTVVILGMDGSFYRCQFDPVNGGEMSQLEYHNCLKPPVF

SEQ ID NO: 5407 - DNA, 2494 bp, Zea mays
  misc_feature (1)..(2494): Ceres cDNA ID no. 22005773
  misc_feature (1)..(2494): Ceres CLONE  ID no. 1390066
  misc_feature (1)..(2494): Also known as  Ceres CDNA ID no. 23852486
aaaacttgccctcttctctgcttgaaccgcggagcaagaccgctcttgttctcttctctgcttgaactgcggagaaagaccgaatccgaagggacgttgggactttctggctgggaagactacataccatttctctaattcgggcgtggtttgtgctgggagggaaggaatccatggggctgcagctcgatccgcgctgagagttgaaggaaccggccttgttgtgtgctccacccaatcgaggaaaaggggcaaggattgctgctttgttgtctttggatccgttacgccattggggattcaaccatcagcagggcgaagtgacggttctgcaccacttttccccttatcctaattcgattttatttgaacactggatgtgattataatctcggttgctgttctgtgcggctctatctgagggtttcctccgtcctggatcgggaaggaaggcgcccttggatttccgtctccatggcgcccgccttgtaacccacggagtctaacttttaaatttagtgtaaatattagtggtagcagctgttaaggaagccccggtctccttagtagccaccgtgtgaatatgtcgtcagctggtgtgatcgtcttggggccagtcccaaaagaccctgctttcctgcctatctgcttcaacggcagccggtcgccacactgctcgtctgggtcacagctgcaggattccattcttattttccttgctgtgcctggtatgtcacccatgcccatgagcgtgctggaatctgagtccattgcctccgtgaagctgcgcatccagcggttcaaaggctttgtggcgacgaagcagcggcttgtgctggatgggcatgaactggcaagaaataactgcccagtcaaggattatgggctggctgagggaaatgttcttcatcttgttattcgactgtctgatctccgtgtgatcaatattgagactgcaactggaaagaagtttcagtttcaggtggatcagagccgcaatgttaagtttcttaagaacaagcttgcagcagagggtgatgaggatattggtaatcttcaggatcacaagcttgaatatgatggcgaggagcttgaggaccaccagctgatagctgatattagcaagagggatgatgctgtaattcatttgttcatcctcaaaccagcaaaagtactgacacagcaagttgatagagatactttggttacagttctcaatccacaggagaaaggcaacctgcaaaatgaacctcgctcaatgaactccacaaaatcagttgaggttaggcctgctcctgttgaaccaatagttagccaaaatgtgaagctgtcacctgaattgattaagatgataaatttaaccacagttggactggagaaagggcacctgcctgtgatgtcagctgaaggttcaggaggtgtatatttcatgcgagatgcaacaggtcagaagaatattgctgtgtttaagcctattgatgaggaacccatggccaaaaacaacccaaggggtcttcctttgtccactgatggcgaggggatgaagaggggaacaattgtagggggaggtgcattcagggaggttgcagcttatattctcgaccatccagttagtgatagtaaatctggtcacagttttgggttttctggtgtgcctcccaccacattggtccgaacctcgcatagggggaagaacttcaagattggttcactgcagatgttcatggacaacaatggaagcactgaagatatgggtcctcgaccttttcctgtcaaggaggttcataaaatagcagtactagatattaggttagctaatgctgatcgtcatgctgggaatattctagtgtgcaaggagagagaaggtggcaactacaagctgattccaattgatcatggttactgcttgccagagaagtttgaagattgtacatttgagtggctctactggccccaagcccgtgagccattcaatgatgaaaccattgaatacatcaaatcactcgatgctgaagaagacatcaagcttctcaagatccatgggtgggagctgcctccacggtgtgctcgtgtcctgcgcatcagcacaatgcttttgaagaaaggtgcatctcgtggcttcacgccctatgacatagggcgcatactatgcagggaaactgtgaatagggactctgagattgaggtcatcattcaggaagcagaggatgctgttctcccatggtccagtgaaaacatgttcttagaaactttatctgaaatcatggaccgtcacctccacaaggaatgagtttagaaattcagaataacttatctagttgctccagctgtatccggtttgttgtaagtattgtagacaaggggtgtcaagggactaatgatttcatttgtttgtatcctctcaaatgatttcacttggttgtaattgctcgagtactttgcttatgcacattttgtgaataatatatttgtttggctaaaaaaaaaaaaaaaa

SEQ ID NO: 5408 - protein, 568 aa, Zea mays
  misc_feature: PFam Name: PI3_PI4_kinase; PFam Description:
  misc_feature: PFam Name: ubiquitin; PFam Description: Ubiquitin family
  misc_feature: PFam Name: Ras; PFam Description: Ras family
  misc_feature: PFam Name: Arv1; PFam Description: Arv1-like family
  misc_feature: PFam Name: Nsp1_C; PFam Description: Nsp1-like C-terminal region
  misc_feature: GI Number: 50907073; NR Description: phosphatidylinositol 3- and 4-kinase-like [Oryza sativa (japonica cultivar-group)] >gi|47847951|dbj|BAD21741.1| phosphatidylinositol 3- and 4-kinase-like [Oryza sativa (japonica 3- and 4-kinase-like [Oryza
  misc_feature: GI Number: 49328117; NR Description: putative ubiquitin
  misc_feature: GI Number: 56783948; NR Description: ubiquitin -like [Oryza
  misc_feature: GI Number: 10177083; NR Description: ubiquitin [Arabidopsis thaliana] >gi|15237921|ref|NP_197812.1| phosphatidylinositol 3- and 4-kinase family protein / ubiquitin family protein [Arabidopsis
  misc_feature: GI Number: 50932955; NR Description: putative ubiquitin [Oryza sativa (japonica cultivar-group)] >gi|47777373|gb|AAT38007.1| putative ubiquitin [Oryza sativa
MSSAGVIVLGPVPKDPAFLPICFNGSRSPHCSSGSQLQDSILIFLAVPGMSPMPMSVLESESIASVKLRIQRFKGFVATKQRLVLDGHELARNNCPVKDYGLAEGNVLHLVIRLSDLRVINIETATGKKFQFQVDQSRNVKFLKNKLAAEGDEDIGNLQDHKLEYDGEELEDHQLIADISKRDDAVIHLFILKPAKVLTQQVDRDTLVTVLNPQEKGNLQNEPRSMNSTKSVEVRPAPVEPIVSQNVKLSPELIKMINLTTVGLEKGHLPVMSAEGSGGVYFMRDATGQKNIAVFKPIDEEPMAKNNPRGLPLSTDGEGMKRGTIVGGGAFREVAAYILDHPVSDSKSGHSFGFSGVPPTTLVRTSHRGKNFKIGSLQMFMDNNGSTEDMGPRPFPVKEVHKIAVLDIRLANADRHAGNILVCKEREGGNYKLIPIDHGYCLPEKFEDCTFEWLYWPQAREPFNDETIEYIKSLDAEEDIKLLKIHGWELPPRCARVLRISTMLLKKGASRGFTPYDIGRILCRETVNRDSEIEVIIQEAEDAVLPWSSENMFLETLSEIMDRHLHKE

SEQ ID NO: 5409 - DNA, 825 bp, Zea mays
  misc_feature (1)..(825): Ceres cDNA ID no. 22005774
  misc_feature (1)..(825): Ceres CLONE  ID no. 1391521
  misc_feature (1)..(825): Also known as  Ceres CDNA ID no. 23854611
aagccccctttgcgagacaagagaagagaaacaagcagccatggtgtgcatcaggcgagcgacggttgacgatctgctggcgatgcaagcctgcaatctcatgtgtcttcccgagaactaccagatgaagtactacctctaccacatcctctcctggcctcagcttctctacgttgccgaggactacaacggccgcatcgtcggctatgtcctcgccaagatggacgaggagagtaacgagtgccacggccacatcacttccctcgctgttcttcgtactcatcggaagcttggtctcgccactaagctcatgaccgccgctcagtctgccatggaacaggtttatgaggcagagtatgtttcgctgcacgtgaggagaagtaaccgagcagcgtttcatctgtacacggagacgttaggctacaagattcacgatgtggaagcgaagtattacgctgatggagaggatgcctatgacatgcggaagtattttaagggtaagcaaaaccatcaacagagccacggtcatcatcatcatcatcatcatggaggtgggtgttgttccggtgatgcagtagatacaactccagccgaagatgctatagcaacgacgtcgaagtgagactgagttgtattggtgtgtgtttgctggctagctctagtagtgctgctcactattttccattcatatgattttgagtgtcaaaacacatttggtaaaccactcttgtgcttgagtgtttctccattggtcttctttttggttgtacttgatatttattagccagtcttttttttttctatgtatcaaaaaaaaaaaaaaaa

SEQ ID NO: 5410 - protein, 193 aa, Zea mays
  misc_feature: PFam Name: Acetyltransf_1; PFam Description:
  misc_feature: GI Number: 14550116; NR Description: silencing group B
  misc_feature: GI Number: 33871453; NR Description: MGC10646 protein [Homo
  misc_feature: GI Number: 39645307; NR Description: MGC10646 protein [Homo
  misc_feature: GI Number: 51593357; NR Description: MGC10646 protein [Homo
  misc_feature: GI Number: 62664674; NR Description: PREDICTED: similar to DNA segment, Chr 18, Wayne State University 98, expressed [Rattus
MVCIRRATVDDLLAMQACNLMCLPENYQMKYYLYHILSWPQLLYVAEDYNGRIVGYVLAKMDEESNECHGHITSLAVLRTHRKLGLATKLMTAAQSAMEQVYEAEYVSLHVRRSNRAAFHLYTETLGYKIHDVEAKYYADGEDAYDMRKYFKGKQNHQQSHGHHHHHHHGGGCCSGDAVDTTPAEDAIATTSK

SEQ ID NO: 5411 - DNA, 2195 bp, Zea mays
  misc_feature (1)..(2195): Ceres cDNA ID no. 22005775
  misc_feature (1)..(2195): Ceres CLONE  ID no. 1393104
  misc_feature (1)..(2195): Also known as  Ceres CDNA ID no. 0
gagaaaaaacataggggtcccggtgacctaactctgcctccgggccatcgccggagttgcgccgccgccctagtctacagtgctaccaccacctagataggctacctgcaggttgtggcgtcggatgcttcaccgtgcactcgaaccctacgagagtcttggaagttgcaactcgcgcgacggtagcgaggggaagcgaagtcagcagacggcaacagagtccagacgagggaggggaaggcggcttccggctccagccgagaacccaaaaggagatccggaaaacgacacgagcactgcctgcctgcgcaccgcctccagttggcacttggcagccgcctataaatcccaccgcgggccggatccccatcgtcctgcccccgtgccctcgccgatcagcgatcaacaaaccactcctttcctctcctctcgtcatggtgttccggacttcccgttgcctcgaaatccacagctgtagctgacagaaggcattcttgggagtactagcgacttaccgagccgagcaagcgctagctctccatgtccatggccgatgcaaaggacgacgcggcaatggcggaggcccagcccctgggacggtggccggtgctgtcctacggcgtcggccacatgctgaacgacatcacgtcggcatgctggttcacgtacctgctcctcttcttgcagcagatcggccttgctcccagggccgccgccgttgtgatgctctcgggccaggtcgcggacgggctgatgacgatcctcgcaggcgagatgatcgacaggtttggccgcttcaagctatggcacatcggagggtcggtcctcgtcggcttctccttctcctcggtctttggtggctgcctgctgtgcaccatcctggggacggactcgtacctcgtgaggaccgtgggctacagcttcttcgcggcggtgttcaacgttggctgggcggccacacaggtctcccacatgtccatggtgaactgcatgacactgaatccgacaagccgtgtagccttagcaagctgcagaaacgcatccactatggtcgcaaatcttggtttgtatgggattgcgttaggtgtctttggcgctataaaggcgaaagaatactcagacattgttactcagtaccgatggatcgcgtacctgtccattttcatcggatgctgcttcctggtggtctttcatgctggaaccaaggagcctactttgaagtctgaacctagctgtaagaaggcggctcggatttcctgggggtactggttcaagaagaccctgtactaccaagttgctctcctttatatgcttgcgaggctgatcacaaacgtatctcagtcgctcatcgctttctacgtcaccagagatttgagaatgaatgagtactcgaaagcaataataccagccatcatattctgctgcagcttcttcgtgtccatcgtactgcaggagatcaagtggaccagccggcgcctcaagtccctcctcaccgtcggcgccacgctatgggtcatctccggcgtggccgtcttcgtcctcccgagccagatgaacagcctgatgtaccctctcgccatggtcatcggcgccgccaacgcgctcgtcatggtcacgacgatcgggctggagggcgcgttggtaggggaggaccttaacggctgcgccttcgtctacggctccctcagcttcctggacaagatctcctgcggaatcgcgctgttcgcgctggaatcgtacgaagacacgatggtgagctacggcgagacgaggggcctcaacacggtgagcaggtacgggacgggcctgatcccctcctgcttcgccgtactctccctggtggtcacctccacgctgaggctgcaggacgacaccccgagagccgctgcactggatgccccgctgcttgtctgattgtgaccgaagaaaaaaaaaaccggtggtgtgatattgtcgctcgctcgggttggaagagagaagaaatgtgcagcctcttcaattaggtttgaggggggatacgtcgcctgctttcaattagttttgaaacgggccactttgtaataaaattttccattccattccgtggcgttggcatcatggcatataaacagattcatagtcttggtgttaaaaatgtatgagaacaggttgctataagtaacttttaagggctctttggaaaaaaaaaaaaaaaa

SEQ ID NO: 5412 - protein, 2195 aa, Zea mays
GAGAAAAAACATAGGGGTCCCGGTGACCTAACTCTGCCTCCGGGCCATCGCCGGAGTTGCGCCGCCGCCCTAGTCTACAGTGCTACCACCACCTAGATAGGCTACCTGCAGGTTGTGGCGTCGGATGCTTCACCGTGCACTCGAACCCTACGAGAGTCTTGGAAGTTGCAACTCGCGCGACGGTAGCGAGGGGAAGCGAAGTCAGCAGACGGCAACAGAGTCCAGACGAGGGAGGGGAAGGCGGCTTCCGGCTCCAGCCGAGAACCCAAAAGGAGATCCGGAAAACGACACGAGCACTGCCTGCCTGCGCACCGCCTCCAGTTGGCACTTGGCAGCCGCCTATAAATCCCACCGCGGGCCGGATCCCCATCGTCCTGCCCCCGTGCCCTCGCCGATCAGCGATCAACAAACCACTCCTTTCCTCTCCTCTCGTCATGGTGTTCCGGACTTCCCGTTGCCTCGAAATCCACAGCTGTAGCTGACAGAAGGCATTCTTGGGAGTACTAGCGACTTACCGAGCCGAGCAAGCGCTAGCTCTCCATGTCCATGGCCGATGCAAAGGACGACGCGGCAATGGCGGAGGCCCAGCCCCTGGGACGGTGGCCGGTGCTGTCCTACGGCGTCGGCCACATGCTGAACGACATCACGTCGGCATGCTGGTTCACGTACCTGCTCCTCTTCTTGCAGCAGATCGGCCTTGCTCCCAGGGCCGCCGCCGTTGTGATGCTCTCGGGCCAGGTCGCGGACGGGCTGATGACGATCCTCGCAGGCGAGATGATCGACAGGTTTGGCCGCTTCAAGCTATGGCACATCGGAGGGTCGGTCCTCGTCGGCTTCTCCTTCTCCTCGGTCTTTGGTGGCTGCCTGCTGTGCACCATCCTGGGGACGGACTCGTACCTCGTGAGGACCGTGGGCTACAGCTTCTTCGCGGCGGTGTTCAACGTTGGCTGGGCGGCCACACAGGTCTCCCACATGTCCATGGTGAACTGCATGACACTGAATCCGACAAGCCGTGTAGCCTTAGCAAGCTGCAGAAACGCATCCACTATGGTCGCAAATCTTGGTTTGTATGGGATTGCGTTAGGTGTCTTTGGCGCTATAAAGGCGAAAGAATACTCAGACATTGTTACTCAGTACCGATGGATCGCGTACCTGTCCATTTTCATCGGATGCTGCTTCCTGGTGGTCTTTCATGCTGGAACCAAGGAGCCTACTTTGAAGTCTGAACCTAGCTGTAAGAAGGCGGCTCGGATTTCCTGGGGGTACTGGTTCAAGAAGACCCTGTACTACCAAGTTGCTCTCCTTTATATGCTTGCGAGGCTGATCACAAACGTATCTCAGTCGCTCATCGCTTTCTACGTCACCAGAGATTTGAGAATGAATGAGTACTCGAAAGCAATAATACCAGCCATCATATTCTGCTGCAGCTTCTTCGTGTCCATCGTACTGCAGGAGATCAAGTGGACCAGCCGGCGCCTCAAGTCCCTCCTCACCGTCGGCGCCACGCTATGGGTCATCTCCGGCGTGGCCGTCTTCGTCCTCCCGAGCCAGATGAACAGCCTGATGTACCCTCTCGCCATGGTCATCGGCGCCGCCAACGCGCTCGTCATGGTCACGACGATCGGGCTGGAGGGCGCGTTGGTAGGGGAGGACCTTAACGGCTGCGCCTTCGTCTACGGCTCCCTCAGCTTCCTGGACAAGATCTCCTGCGGAATCGCGCTGTTCGCGCTGGAATCGTACGAAGACACGATGGTGAGCTACGGCGAGACGAGGGGCCTCAACACGGTGAGCAGGTACGGGACGGGCCTGATCCCCTCCTGCTTCGCCGTACTCTCCCTGGTGGTCACCTCCACGCTGAGGCTGCAGGACGACACCCCGAGAGCCGCTGCACTGGATGCCCCGCTGCTTGTCTGATTGTGACCGAAGAAAAAAAAAACCGGTGGTGTGATATTGTCGCTCGCTCGGGTTGGAAGAGAGAAGAAATGTGCAGCCTCTTCAATTAGGTTTGAGGGGGGATACGTCGCCTGCTTTCAATTAGTTTTGAAACGGGCCACTTTGTAATAAAATTTTCCATTCCATTCCGTGGCGTTGGCATCATGGCATATAAACAGATTCATAGTCTTGGTGTTAAAAATGTATGAGAACAGGTTGCTATAAGTAACTTTTAAGGGCTCTTTGGAAAAAAAAAAAAAAAA

SEQ ID NO: 5413 - DNA, 1022 bp, Zea mays
  misc_feature (1)..(1022): Ceres cDNA ID no. 22005776
  misc_feature (1)..(1022): Ceres CLONE  ID no. 1393136
  misc_feature (1)..(1022): Also known as  Ceres CDNA ID no. 23858309
aaagcttttcagatcttaatagaagaagaacctaaacttctctcgatccgacaaaaagatgacttttactattccgatcgataacggagattccgtgaagaccgcagaagctgattcacaaagaacactgtacccatatgttactgggacttctattgtcgcaatcaagtacaaggatggggttttaatggcttccgacatgggaggttcatatggatccaccttaaggtacaagaacattgagagaatgaaggctattggtaagcattctcttctcggtgccagcggagaaatcagtgactttcaggagattcttcgttatcttgatgagcttgttttgaatgataacatgtgggatgatggtaactctttggggccgaaagaggtgcacaactatctgacccgagtgatgtacaaccgtcgcaacaagtttaaccctctctggaacactctcgtccttggaggtgtcaaaaatggggaaagttaccttggcatggtgtcaatgattggtgttagtttcgaggacaatcatgttgccaccggatttggaaaccacctcgctaggcctattcttcgtgatgagtggcatgcagacctgagttttgaagatggtgtcaagctccttgagaaatgtatgcgtgtgcttctgtaccgtgacagatctgccattaacaagcttcagatagcgaagatcacagaagaaggcgtgacggtttctcagccatactcgttgaagacattctgggaattcaaggcgttcaacaatccgactgctggtgctgaaggctcctggtaagaagcctaatcaaccacatactgcctggagatctttcaagaacgcttcctttttttatgttatttcgtgtgatgttaaattactatgtactctagtggttttcctagcaacaattgtggttatttcatgaaatttcggagttagatcgataaaaatttatggatatttcttaatatctttggactaaactaatctcaaaattttcttcgtaaaaaaaaaaaaaaaa

SEQ ID NO: 5414 - protein, 245 aa, Zea mays
  misc_feature: PFam Name: Proteasome; PFam Description: Proteasome A-type
  misc_feature: GI Number: 15450551; NR Description: At1g56450/F13N6_3 [Arabidopsis thaliana] >gi|15010590|gb|AAK73954.1| At1g56450/F13N6_3 [Arabidopsis thaliana] >gi|14190405|gb|AAK55683.1| At1g56450/F13N6_3 [Arabidopsis
  misc_feature: GI Number: 3421123; NR Description: 20S proteasome beta subunit PBG1 [Arabidopsis thaliana] >gi|25290071|pir||T51986 C 3.4.25.1 proteasome endopeptidase complex () chain PBG1 [imported]
  misc_feature: GI Number: 50725360; NR Description: beta 7 subunit of 20S proteasome [Oryza sativa (japonica cultivar-group)] >gi|8671512|dbj|BAA96839.1| beta 7 subunit of 20S proteasome [Oryza
  misc_feature: GI Number: 14594935; NR Description: putative beta7
  misc_feature: GI Number: 2511598; NR Description: multicatalytic endopeptidase complex, proteasome component, beta subunit
MTFTIPIDNGDSVKTAEADSQRTLYPYVTGTSIVAIKYKDGVLMASDMGGSYGSTLRYKNIERMKAIGKHSLLGASGEISDFQEILRYLDELVLNDNMWDDGNSLGPKEVHNYLTRVMYNRRNKFNPLWNTLVLGGVKNGESYLGMVSMIGVSFEDNHVATGFGNHLARPILRDEWHADLSFEDGVKLLEKCMRVLLYRDRSAINKLQIAKITEEGVTVSQPYSLKTFWEFKAFNNPTAGAEGSW

SEQ ID NO: 5415 - DNA, 901 bp, Zea mays
  misc_feature (1)..(901): Ceres cDNA ID no. 22005777
  misc_feature (1)..(901): Ceres CLONE  ID no. 1396997
  misc_feature (1)..(901): Also known as  Ceres CDNA ID no. 24359652
attttacccctccgtccgtctctcacactgtctctctccaccctctcgctctccgacaaggcgacgacgggtaggccaccgccgccggcgccgtcccactacgacaactgctgaggccttcatcgctttcttcgccggcgacgagcacccaccaactaaggtcatggaagagatgatagatctaacgggggatggaggtgttcttaagacagtagtgcggaaagcaaaagatgatgctatagcgccatccgagagcctgcccttggttgatgttcattacgaaggtacacttgctgagactggtgaagttttcgataccacccatgaagataactctattttctcatttgaaattggacaaggcgctgtcatcaaagcatgggatatagccttaagaactatgaaggttggcgaggttgcaaaaattacatgcaaatcagaatatgcatatggagctgcaggctcaccaccagagatacctcctaatgcaacccttatttttgaggtggagctagtagcttgcaggccgaggaaaggttcaagcttaggtagtgtatctgatgagaaagccagacttgaagaacttaagaagcaacgggagctagctgctgctaccaaagaagaggagaaaaagaagagggaggaagcgaaggccgcggcagcagcccgggtgcaagcaaagcttgatgccaagaaggggaaggggaagggaaagggaaaatagatcgtgacgttgctgctgactattgttgtaaccaagaaaataattgtgggagcgtcctcaaactgctccgtcacttgctggttactgtgcttgatgttgtagcgtggactaatgtatcgaaaagacctaagtataaataatgtctggtatctacgtagaccaaaaaaaaaaaaaaaa

SEQ ID NO: 5416 - protein, 186 aa, Zea mays
  misc_feature: PFam Name: FKBP_C; PFam Description: FKBP-type
  misc_feature: GI Number: 52353447; NR Description: putative peptidylprolyl
  misc_feature: GI Number: 56784251; NR Description: putative peptidylprolyl
  misc_feature: GI Number: 30172151; NR Description: peptidylprolyl cis-trans
  misc_feature: GI Number: 34908226; NR Description: P0406G08.28 [Oryza sativa (japonica cultivar-group)] >gi|19571040|dbj|BAB86467.1|
  misc_feature: GI Number: 50513335; NR Description: Chain A, Crystal
MEEMIDLTGDGGVLKTVVRKAKDDAIAPSESLPLVDVHYEGTLAETGEVFDTTHEDNSIFSFEIGQGAVIKAWDIALRTMKVGEVAKITCKSEYAYGAAGSPPEIPPNATLIFEVELVACRPRKGSSLGSVSDEKARLEELKKQRELAAATKEEEKKKREEAKAAAAARVQAKLDAKKGKGKGKGK

SEQ ID NO: 5417 - DNA, 1300 bp, Zea mays
  misc_feature (1)..(1300): Ceres cDNA ID no. 22005778
  misc_feature (1)..(1300): Ceres CLONE  ID no. 1397168
  misc_feature (1)..(1300): Also known as  Ceres CDNA ID no. 24365132
agatttggttccctcccttatcctattccctcgtgtcatggcgcttctcctgcgcctcgctgctccgtcggtgccgccccggcggagctccggcctcagagcattgccgcgcgtcgtccttccggaggtcgtttccaaacaatcatttcttcgtttactagttgacagcactgcaagtatgccctgtcctattaagtgttctgcggctcggtgtgccccatcattgactgaacacaacgattctaggaataatggcatccatgcatctagtgtatatggacatgatctcatgaagtccatgtctgatctccaggaagttgtattttcctcctttagcaaagcatgtcttctcagtagttgtatcatatatggtctaccacccagttgtatagcagaaccatgtgagcaagaatactttctccctaacatgcctttgctgttcgcaatagccatggttggtgctactgttggagggctccttgcgagacagaggagaggggagcttgcacgtctaaatgatcaattgcgtcagataaatgctgcattgagaagacaagccaagattgaatcttatgctcctgccttgagctatgccccagttggtagcaagataccagaatcagaagttattgttgatcctcagaaacagcgcctaattgcatatctcaggaccggaaagaactatctgagaaaccaagctcctgacaaggcatttcctgagtttaaggcagctcttgatcttgcacgatctttaggtgatcatgttgaagagaagaaggcagcacgaggattaggggcatccttgcaaagacaaggcaagtacaaggaagccataaattatcattccatggtgctaaacatctccaaggtgaccggagaggatgcgggtgtcactgaagcatacggagcaatagcggattgctacaccgagcttggtgagctcgagaaggcaggcaagttctacgacaagtacatagcaagattggagaacgaatgagaaaacagtgctgattggcaaatctgtgagagcagaaacaaagacaaggctaatcatatctctactcttgtcgtcatgtattctactatagatgtgcagttcccagctggaactgatgtttgttatcatgattcaagtttctttttggcagaattatcccagatgtttaggtacagatcagtatcatgctgtgcacgtagttgttttgttaattagggtctcaatggtccgtacaggcattcatgtcaatctgctagttgcgccggcttaattttatagttttgctgaaaaaaaaaaaaaaaa

SEQ ID NO: 5418 - protein, 319 aa, Zea mays
  misc_feature: PFam Name: TPR_1; PFam Description: Tetratricopeptide repeat
  misc_feature: GI Number: 34914598; NR Description: P0520B06.12 [Oryza sativa (japonica cultivar-group)] >gi|20804493|dbj|BAB92188.1|
  misc_feature: GI Number: 42572429; NR Description: tetratricopeptide repeat
  misc_feature: GI Number: 21593122; NR Description: unknown [Arabidopsis thaliana] >gi|17386154|gb|AAL38623.1| AT3g14110/MAG2_6 [Arabidopsis thaliana] >gi|15450619|gb|AAK96581.1| AT3g14110/MAG2_6 [Arabidopsis
  misc_feature: GI Number: 50909895; NR Description: putative tetratricopeptide repeat (TPR)-containing protein [Oryza sativa (japonica cultivar-group)] >gi|46806280|dbj|BAD17488.1| putative tetratricopeptide repeat (TPR)-containing protein [Oryza sativa
  misc_feature: GI Number: 51950311; NR Description: chloroplast Flu-like
MALLLRLAAPSVPPRRSSGLRALPRVVLPEVVSKQSFLRLLVDSTASMPCPIKCSAARCAPSLTEHNDSRNNGIHASSVYGHDLMKSMSDLQEVVFSSFSKACLLSSCIIYGLPPSCIAEPCEQEYFLPNMPLLFAIAMVGATVGGLLARQRRGELARLNDQLRQINAALRRQAKIESYAPALSYAPVGSKIPESEVIVDPQKQRLIAYLRTGKNYLRNQAPDKAFPEFKAALDLARSLGDHVEEKKAARGLGASLQRQGKYKEAINYHSMVLNISKVTGEDAGVTEAYGAIADCYTELGELEKAGKFYDKYIARLENE

SEQ ID NO: 5419 - DNA, 1083 bp, Zea mays
  misc_feature (1)..(1083): Ceres cDNA ID no. 22005779
  misc_feature (1)..(1083): Ceres CLONE  ID no. 1397177
  misc_feature (1)..(1083): Also known as  Ceres CDNA ID no. 0
atacctttctcggccttttggctaagatcaagtgtagtatctgttcttatcagtttaatatctgatatgtgggccatcggcccgctcgatattaactctattttttaagggagaaagcccactaagatagcttgctatctgggctttcaagagtcgctcatgcgttgcactattgcacgggccggctcaacccgccaaatcacaagtcgaagatggcgaaccctaggagaacagtgacggagaaccatagattatcaccattgatcaatctactgaagaagcctcaagcgtttcctctgcttctctccttcttcctcttcctcacatggatcactctcaggttacagcactcttctcacctctcttcgtcttcttcgcatacgaaatcggcagcgaagagtcaccatcatcctgattcggaagtcctcgacggagacgataaggttaatctgatccggttcgatacagcgtcgatttcgcctgttagaaaagacgatcgtgggtggctgcttgatcccgttgctcttgctcgtgattctcagctccacggtggagcagccacgtgtgtttccattcatgttggtgaaatcaagcctggtgaattgaggggaaaccacagacaccatacttgtaacgagacgtttgtcatttggggagccaagacgagattcaggctggagaatcacaaggtggaaaaaggctatgcagaagttttaattggagaggatgaagtagctgtagcggttagtcctagtggcacagcacatgctatagtaaatgtcgatcctgtgcgttctactttcttaatcggctgccaagacagtaatatgcacaacagctcaactagcgactacaaagtatggaaagatctttaatcccatatttgtttagtttcttcatttggattttcattggtcttttatgtaatcagctttctctggtttctttctttcgagctcttatttgtatagaataggctttttttgtttcttttgtcagtgtctgttactctgattattaaccctgaaacttccaatgtctagaagttcattgttatgtttcatgataaaaaaaaaaaaaaaa

SEQ ID NO: 5420 - protein, 220 aa, Zea mays
MANPRRTVTENHRLSPLINLLKKPQAFPLLLSFFLFLTWITLRLQHSSHLSSSSSHTKSAAKSHHHPDSEVLDGDDKVNLIRFDTASISPVRKDDRGWLLDPVALARDSQLHGGAATCVSIHVGEIKPGELRGNHRHHTCNETFVIWGAKTRFRLENHKVEKGYAEVLIGEDEVAVAVSPSGTAHAIVNVDPVRSTFLIGCQDSNMHNSSTSDYKVWKDL

SEQ ID NO: 5421 - DNA, 977 bp, Zea mays
  misc_feature (1)..(977): Ceres cDNA ID no. 22005780
  misc_feature (1)..(977): Ceres CLONE  ID no. 1397512
  misc_feature (1)..(977): Also known as  Ceres CDNA ID no. 23854649
ctcagtctcccctactatggccttgcctatctccggcacgcgccacctcacgcgctccctcttgtccagtaccaccttactcgcgcctcctaagcttccttcctccgttcgctgcggtgggtttagctccggtcacgatgcggttgtacctcggtttacctcactccgatgccgagctaaccgttcaggctccgcttactcgccgctcaactccggctccaacttcagcgaccgacctccgacggagatggcgcctctgttcccgggatgcgattacgagcactggctgattgttatggacaagcccggcggcgaaggagcgacgaagcaggagatgattgattgttacgtacaaactttagctaaagtcgttggaagtgaggaagaggcgaagaagaggatttacaatgtttcgtgtgagaggtatttggggtttgggtgtgagattgatgaagagacatctactaagcttgaaggtttgcctggtgttctgtttgtgcttccggattcatatgtggatcctgagaacaaagattatggagcggagctatttgttaatggagagatagtccaacgatcaccagagaggcagaggagagttgagccacagccgcagagagcgcaagatagaccgagatacaatgacagaacgcgttactctcgccgcaaagaaaacacacgctgagccgcgactgaagaagatacgcgtacaccgtattgaatcaaatcgaaagcgagtacgatagtggtgatcatgaggatgatgttgctgctgccaggcgaaggttccatgttccaccccgttgctgctaatcgatcaactttggatattgttgcaaatgcttagtttcggtactgtgtaacatctttatatgtaataatgtaaattgaggttacttttactgttttagagaagacactgggatatttgggcatcaaaattcgttttcctttctagaacaaaaaaaaaaaaaaaa

SEQ ID NO: 5422 - protein, 222 aa, Zea mays
  misc_feature: GI Number: 20453405; NR Description: At2g33430/F4P9.20 [Arabidopsis thaliana] >gi|2459425|gb|AAB80660.1| plastid protein [Arabidopsis thaliana] >gi|17933285|gb|AAL48226.1| At2g33430/F4P9.20 [Arabidopsis thaliana] >gi|25370551|pir||D84745
  misc_feature: GI Number: 2440029; NR Description: DAL1 protein [Arabidopsis thaliana] >gi|2440031|emb|CAA75115.1| DAL1 protein [Arabidopsis
  misc_feature: GI Number: 21617909; NR Description: plastid protein
  misc_feature: GI Number: 2246378; NR Description: plastid protein [Arabidopsis thaliana] >gi|25370552|pir||T52623 DAG protein homolog
  misc_feature: GI Number: 20465721; NR Description: putative plastid protein [Arabidopsis thaliana] >gi|17381078|gb|AAL36351.1| putative plastid protein [Arabidopsis thaliana] >gi|25370553|pir||D86451 probable
MALPISGTRHLTRSLLSSTTLLAPPKLPSSVRCGGFSSGHDAVVPRFTSLRCRANRSGSAYSPLNSGSNFSDRPPTEMAPLFPGCDYEHWLIVMDKPGGEGATKQEMIDCYVQTLAKVVGSEEEAKKRIYNVSCERYLGFGCEIDEETSTKLEGLPGVLFVLPDSYVDPENKDYGAELFVNGEIVQRSPERQRRVEPQPQRAQDRPRYNDRTRYSRRKENTR

SEQ ID NO: 5423 - DNA, 660 bp, Zea mays
  misc_feature (1)..(660): Ceres cDNA ID no. 22005781
  misc_feature (1)..(660): Ceres CLONE  ID no. 1399546
  misc_feature (1)..(660): Also known as  Ceres CDNA ID no. 23857948
tcattagggttttctcttcctctcatttatcacttcggctgctgcaagtgagcaaccgaatcataaaaccctagccatggcgacgaaaccagctaaacaatccgtgcaatgcttcgggaggaagaagacggccgtcgccgtcacccactgcaagcccgggtgcggtatgatcaagctcaacggttccccgatcgagctattccagcccgagatcctcaggttcaagatctacgagccggtccttctcctagggaagcaccgtttcgcgggggtggacatgaggatccgtgtcaagggaggtggtcacacttcacaggtgtacgcgattcgtcagagtatcgctaaggcgttggttgcgttttaccagaagtatgtggatgagcagtcgaagaaggaggtgaaggatattttgataaggtacgataggactttgcttgttgcggatccgaggaggtgcgagccgaagaagtttggtgggcgtggtgctcgttctcgtttccagaagagttaccgttaaaactattctggtttgtttatttctcaaaatgagttgttgaattgtgagacgttagattctcatttgcgtttttttttaattgttgttggattatggttacttcgttaaagaacttatggttttttacaaaaaaaaaaaaaaaa

SEQ ID NO: 5424 - protein, 146 aa, Zea mays
MATKPAKQSVQCFGRKKTAVAVTHCKPGCGMIKLNGSPIELFQPEILRFKIYEPVLLLGKHRFAGVDMRIRVKGGGHTSQVYAIRQSIAKALVAFYQKYVDEQSKKEVKDILIRYDRTLLVADPRRCEPKKFGGRGARSRFQKSYR

SEQ ID NO: 5425 - DNA, 813 bp, Zea mays
  misc_feature (1)..(813): Ceres cDNA ID no. 22005782
  misc_feature (1)..(813): Ceres CLONE  ID no. 1404085
  misc_feature (1)..(813): Also known as  Ceres CDNA ID no. 0
cttcttcttcttcttcttcttcttcgcctctctctagctaaaagctatcgcgcgaattgatcgatccctgacaagatccattcatccaccatcgggcgccatggaggattccacggccacgacgacgacgtcttcgactcatcattatttcaccattttcacgaattaccctctcatctcctccctcacggctttcaccatcgctcaattcatcaaactcttcacctcctggtatagggaaaggagatgggatctcaaacagcttattggctccggaggaatgccttcttctcattcagctaccgttactgctctcgctgtagcaatcggtttacaagagggcttcggtggttctcatttcgctattgctttgatcttagcttctgttgtgatgtatgatgctactggtgtcaggttacacgctggtcgccaagctgaggttctcaatcagattgtctacgaacttcctgcagaacatcccttggctgaaagcagaccattgcgtgaacttctcggccatacccctccccaggtcattgctggtggaatgcttggaagtgtcacagcagtcactggatatttatttaccagggtagctactagctaacgtaaacgaaccaatcatagacgcaactcgcctgcttcattgcctagtgaaaccactcgacagtggacagaaccgaagcagatttacattcaaagccttagtttgattcactacatatataatcgtattcatgaactttctatttgaaatgtaaagaaaacttgaatcatcataacaaaaaaaaaacgccaaaaaaaaaaaaaaaa

SEQ ID NO: 5426 - protein, 168 aa, Zea mays
MEDSTATTTTSSTHHYFTIFTNYPLISSLTAFTIAQFIKLFTSWYRERRWDLKQLIGSGGMPSSHSATVTALAVAIGLQEGFGGSHFAIALILASVVMYDATGVRLHAGRQAEVLNQIVYELPAEHPLAESRPLRELLGHTPPQVIAGGMLGSVTAVTGYLFTRVATS

SEQ ID NO: 5427 - DNA, 1849 bp, Zea mays
  misc_feature (1)..(1849): Ceres cDNA ID no. 22005783
  misc_feature (1)..(1849): Ceres CLONE  ID no. 1407203
  misc_feature (1)..(1849): Also known as  Ceres CDNA ID no. 24359599
atccaatacccccacgaacccactctctctccccacgatggcaaaaatggcgatggcgtcctcccgcctcccggctctcctctgcctcgccgccgtcgccgtcgccgtcgcggcggaggccgccgccgccgccggagaaggcggcctccgcctgccccgcgacgccacgttcccggcggcgcaggcggagcggctcatccgcgcgctcaacctcctgcctaaggagaaggaggcggggccggccgcgggcggcggcgacgggcccagcgtggcgcccggggagctcctagagcgtcgcgtccggctgcccggcgcgcccgccggcgtcggggacctcggccaccacgccggatacttccgcctgccgcacacgcacgacgccagaatgttctacttcttcttcgaatcgaggggcaagaagaaggaggacgaccccgtcgtgatctggctcaccggagggcccggctgcagcagcgagctggccgtcttctacgagaatgggcccttcaccattgccaacaacatgtcgcttgtctggaacaaattcggttgggacacgatctcaaatatcatatttgttgatcagccaaccggaactggctttagctacagctctgatgatcgtgatactcgtcatgatgagattggtgtcagcaatgacctatatgactttctccaggtgttctttaagaagcacccagaatttgcaaagaatgacttctttataactggagaatcttatgctgggcactacattccagcatttgcaagcagagttcaccaaggaaacaaagcaaacgagggcattcatataaacttgaagggatttgctatcggcaacggtctcactgatccagaaatccaatacaaagcctacacagactatgcgctggaaatgaatcttatcacaaaatccgactacgaaaggatcaataggttcattccaccatgtgaatttgcaattaagatgtgtggtactgacgggaaagcatcatgcatggcagcttatatggtctgcaacaacatttttaactccatcatgaagcttgtcgggacaaagaactactatgacgtgaggaaggaatgcgaggggaagctttgctatgacttctcaaacctggagaggttcttcggtgacaaagcggtcaaggaggcgcttggagtcggtgacatcgatttcgtctcttgcagcactacggtttatgaagcgatgctcacggactggatgaggaatctggaagtcggcatcccggcgctgcttgaggatgggattaacgtgcttatatacgctggggagtatgaccttatatgcaattggctgggaaactcgagatgggtgcactcgatggaatggtctggccagaaagacttcgtatcctcctgtgactcaccgtttgtagtagacggtgcagaagctggagtcttgaagagccatggaccactgagcttcctcaaggtccacaatgcggggcacatggttccgatggaccagccgaaagctgccctggagatgctgaggagattcacgcaagggaaactgaagcaggaaccgctccctgagacgatggccttgaaggcggcgatgtgactggcgtggacgtcgtgaagggaagaagggagtctcttaattactaggtggtccgaggtgtcgttcaagcgagcgtgtgtcgatcactgagctgctgaagcttgttgtttccattggctcatggatggatgctgttgataagaagttcaatgctggaaaccctgtctgtctgctgctcttgtaaagcatctcatgtatacaccccctggatccagaaagagaaataatatgtttttttccttagcaaaaaaaaaaaaaaaa

SEQ ID NO: 5428 - protein, 1849 aa, Zea mays
  misc_feature: PFam Name: Chal_sti_synt_N; PFam Description: Chalcone and
  misc_feature: GI Number: 20334738; NR Description: At1g68530/T26J14_10 [Arabidopsis thaliana] >gi|17979464|gb|AAL50069.1|
  misc_feature: GI Number: 30697701; NR Description: very-long-chain fatty
  misc_feature: GI Number: 21593111; NR Description: very-long-chain fatty
  misc_feature: GI Number: 21618184; NR Description: fatty acid condensing
  misc_feature: GI Number: 28393607; NR Description: putative fatty acid
ATCCAATACCCCCACGAACCCACTCTCTCTCCCCACGATGGCAAAAATGGCGATGGCGTCCTCCCGCCTCCCGGCTCTCCTCTGCCTCGCCGCCGTCGCCGTCGCCGTCGCGGCGGAGGCCGCCGCCGCCGCCGGAGAAGGCGGCCTCCGCCTGCCCCGCGACGCCACGTTCCCGGCGGCGCAGGCGGAGCGGCTCATCCGCGCGCTCAACCTCCTGCCTAAGGAGAAGGAGGCGGGGCCGGCCGCGGGCGGCGGCGACGGGCCCAGCGTGGCGCCCGGGGAGCTCCTAGAGCGTCGCGTCCGGCTGCCCGGCGCGCCCGCCGGCGTCGGGGACCTCGGCCACCACGCCGGATACTTCCGCCTGCCGCACACGCACGACGCCAGAATGTTCTACTTCTTCTTCGAATCGAGGGGCAAGAAGAAGGAGGACGACCCCGTCGTGATCTGGCTCACCGGAGGGCCCGGCTGCAGCAGCGAGCTGGCCGTCTTCTACGAGAATGGGCCCTTCACCATTGCCAACAACATGTCGCTTGTCTGGAACAAATTCGGTTGGGACACGATCTCAAATATCATATTTGTTGATCAGCCAACCGGAACTGGCTTTAGCTACAGCTCTGATGATCGTGATACTCGTCATGATGAGATTGGTGTCAGCAATGACCTATATGACTTTCTCCAGGTGTTCTTTAAGAAGCACCCAGAATTTGCAAAGAATGACTTCTTTATAACTGGAGAATCTTATGCTGGGCACTACATTCCAGCATTTGCAAGCAGAGTTCACCAAGGAAACAAAGCAAACGAGGGCATTCATATAAACTTGAAGGGATTTGCTATCGGCAACGGTCTCACTGATCCAGAAATCCAATACAAAGCCTACACAGACTATGCGCTGGAAATGAATCTTATCACAAAATCCGACTACGAAAGGATCAATAGGTTCATTCCACCATGTGAATTTGCAATTAAGATGTGTGGTACTGACGGGAAAGCATCATGCATGGCAGCTTATATGGTCTGCAACAACATTTTTAACTCCATCATGAAGCTTGTCGGGACAAAGAACTACTATGACGTGAGGAAGGAATGCGAGGGGAAGCTTTGCTATGACTTCTCAAACCTGGAGAGGTTCTTCGGTGACAAAGCGGTCAAGGAGGCGCTTGGAGTCGGTGACATCGATTTCGTCTCTTGCAGCACTACGGTTTATGAAGCGATGCTCACGGACTGGATGAGGAATCTGGAAGTCGGCATCCCGGCGCTGCTTGAGGATGGGATTAACGTGCTTATATACGCTGGGGAGTATGACCTTATATGCAATTGGCTGGGAAACTCGAGATGGGTGCACTCGATGGAATGGTCTGGCCAGAAAGACTTCGTATCCTCCTGTGACTCACCGTTTGTAGTAGACGGTGCAGAAGCTGGAGTCTTGAAGAGCCATGGACCACTGAGCTTCCTCAAGGTCCACAATGCGGGGCACATGGTTCCGATGGACCAGCCGAAAGCTGCCCTGGAGATGCTGAGGAGATTCACGCAAGGGAAACTGAAGCAGGAACCGCTCCCTGAGACGATGGCCTTGAAGGCGGCGATGTGACTGGCGTGGACGTCGTGAAGGGAAGAAGGGAGTCTCTTAATTACTAGGTGGTCCGAGGTGTCGTTCAAGCGAGCGTGTGTCGATCACTGAGCTGCTGAAGCTTGTTGTTTCCATTGGCTCATGGATGGATGCTGTTGATAAGAAGTTCAATGCTGGAAACCCTGTCTGTCTGCTGCTCTTGTAAAGCATCTCATGTATACACCCCCTGGATCCAGAAAGAGAAATAATATGTTTTTTTCCTTAGCAAAAAAAAAAAAAAAA

SEQ ID NO: 5429 - DNA, 764 bp, Zea mays
  misc_feature (1)..(764): Ceres cDNA ID no. 22005784
  misc_feature (1)..(764): Ceres CLONE  ID no. 1409164
  misc_feature (1)..(764): Also known as  Ceres CDNA ID no. 22005784
aacaatattatctcaaagctaaccaacaatggcgttcccaaaggtgttcttcgacataaacatcaacggccaggcagcgggaaggatcgtgatggagttgtatacggataagacgccgaagacggctgagaatttcagagctctgtgcactggagagaagggagtggggcgtaagggaaagcccctccacttcaagggatcttccttccaccgagtgatccccagtttcatgtgccagggaggtgatttcaccgcgggaaacgggacaggaggtgagtccatctacggtgataagttcgaggacgagaactttgagaggaagcacacgggtcctggcaacctttccatggcgaacgccggagccaacaccaacggatctcagttcttcatctgcaccgtaaaaaccgattggcttgacggtaagcacgtggtgttcgggcaggtggtggaagggttagacgtggtgaaggcgatcgagaaggtgggatcgtcgtctggaaagccgtcgaagccggtggttatcgccgattgtggacagctctcttagatagatctctctcatctatcctcattttaaattatagcgtcagcgtccttgtcctatatatgttatgtatgtttggtgtctcgtttgtatgtgtagtcataatcttggtgtgtattctcatgacagtcttttggattgccagagagaaactcgtcaccctaattacctactaccataaataaatattgaacatcttgcagtaaaaaaaaaaaaaaaa

SEQ ID NO: 5430 - protein, 172 aa, Zea mays
MAFPKVFFDININGQAAGRIVMELYTDKTPKTAENFRALCTGEKGVGRKGKPLHFKGSSFHRVIPSFMCQGGDFTAGNGTGGESIYGDKFEDENFERKHTGPGNLSMANAGANTNGSQFFICTVKTDWLDGKHVVFGQVVEGLDVVKAIEKVGSSSGKPSKPVVIADCGQLS

SEQ ID NO: 5431 - DNA, 1413 bp, Zea mays
  misc_feature (1)..(1413): Ceres cDNA ID no. 22005785
  misc_feature (1)..(1413): Ceres CLONE  ID no. 1410245
  misc_feature (1)..(1413): Also known as  Ceres CDNA ID no. 24373770
aagcacaaaaagaacatcaaatctccaaactttttatttgttttttatatattcaatagcttcttttcactataaattttataggtttcttgtaattgttgtttcatctcattgttggtctgtttattaaggttttatcaatggaagctggtgctttaaactcagtgatcaatagattgcttgaagctagagagaaaccaggaaagattgttcagttgtttgaaactgagatcaaacagctctgtttcgtctctagagatatcttcttgagacaaccaaatctcttggaactcgaagctcctgtcaagatctgtggggacattcatggacaatacccggatctcttgagactattcgaacacggaggataccctcctcgttcaaactacttgtttcttggagactacgtggaccgtggcaagcaaagccttgaaacgatttgtctcttgctcgcttacaagatcaagttccctgaaaacttcttccttcttagaggaaaccacgagagtgcttcaatcaatcgtatctacggcttctacgacgagtgtaaacgccgtttcagtgtcaagatttggagaatcttcaccgattgcttcaactgtctccccgtggctgcactcatcgacgacaggattctctgtatgcacggtgggctctccccggagctgcgtagcttgagacagattagggacattcgccgtccaactgatattcctgatcgtggtttactctgtgatctcttgtggtctgatcctgataaagtggttagaggatggggtcctaacgatcgtggagtttcctacacttttggatcggatacagtttctgagtttctcaaaaggctcgatcttgacctaatctgtagggctcatcaggttgttgaagatgggtttgagttctttgcgaataagcagctcgtgacgatattctcagcgccgaattactgtggagagttcgacaatgcaggtgcgatgatgagtgtagacgaggatttgatttgctcttttcagatcttaaaacctaatgagaagaaatcaaaattcagcttcggaagtagaggtggtgttaaaactggcttcccttatcctaaagtcaagtcgatcctgagttcgcagagttcgaagcaatacaactagttgagacttgagtggttctgaaagcgtacaagtttcacatactgttgttggttccatagcactgagcataagagctacttagcaatcatgctaccgtaacaacaccatatcatggccagagagcaagaggatttttgaattgcgtacttttggaagcttctgttactttttgggttgtttataactttgcgtgtttgtttctcgatgtagttttgtttgtaattgtattaaatttgaataaaacctgttttcttttcgaccaaaaaaaaaaaaaaaa

SEQ ID NO: 5432 - protein, 331 aa, Zea mays
  misc_feature: PFam Name: Metallophos; PFam Description: Calcineurin-like
  misc_feature: GI Number: 49255954; NR Description: MGC79074 protein
  misc_feature: GI Number: 3255941; NR Description: PP1A protein [Catharanthus roseus] >gi|7435136|pir||T09995 phosphoprotein phosphatase (EC 3.1.3.16) 1a catalytic chain - Madagascar
  misc_feature: GI Number: 2654372; NR Description: protein phosphatase 1 [Acetabularia cliftonii] gi|1346750|sp|P48480|PP11_ACECL
  misc_feature: GI Number: 3176076; NR Description: protein phosphatase 1 catalitic subunit [Medicago sativa] >gi|7435133|pir||T09548 phosphoprotein phosphatase (EC 3.1.3.16) 1 catalytic chain delta -
  misc_feature: GI Number: 8843891; NR Description: protein phosphatase 1 catalytic subunit [Arabidopsis thaliana] >gi|2780349|dbj|BAA24283.1| protein phosphatase 1 catalytic subunit [Arabidopsis thaliana] >gi|18422326|ref|NP_568625.1|
MEAGALNSVINRLLEAREKPGKIVQLFETEIKQLCFVSRDIFLRQPNLLELEAPVKICGDIHGQYPDLLRLFEHGGYPPRSNYLFLGDYVDRGKQSLETICLLLAYKIKFPENFFLLRGNHESASINRIYGFYDECKRRFSVKIWRIFTDCFNCLPVAALIDDRILCMHGGLSPELRSLRQIRDIRRPTDIPDRGLLCDLLWSDPDKVVRGWGPNDRGVSYTFGSDTVSEFLKRLDLDLICRAHQVVEDGFEFFANKQLVTIFSAPNYCGEFDNAGAMMSVDEDLICSFQILKPNEKKSKFSFGSRGGVKTGFPYPKVKSILSSQSSKQYN

SEQ ID NO: 5433 - DNA, 572 bp, Zea mays
  misc_feature (1)..(572): Ceres cDNA ID no. 22005786
  misc_feature (1)..(572): Ceres CLONE  ID no. 1411217
  misc_feature (1)..(572): Also known as  Ceres CDNA ID no. 0
attttgatcagagagagagagagagaagctgattcctatggctgctgctgctgcttcactttctgcgagtcaaggtttgctaggaacttccttctatggaggttgggggagttcaatctccggcgaggattaccacaccatgctcgccaaaacaactgcgccacggcaaaactttgctaaactctcacggaaacccatcagagtacagccaatgatgaagaatgtcaacgaaggcaaaggcttgttcgctcctctagtcgttgtcaccaggaacatagtaggcaagaagaggtttaatcagcttagaggcaaagccattgctttacactctcaggtgattacagagttctgcaaatcgataggagctgatgcaaagcagagacaaggattgattaggcttgctaagaagaatggagagaggcttggcttcctcgcttgagatccttccctcttcttctcgtctctgtatacaatcatcttcttcttcttcttgtctcctgtctagatgtattttttccaaacctcttttaaaacataaactgccattctcattctcaaaaaaaaaaaaaaaa

SEQ ID NO: 5434 - protein, 133 aa, Zea mays
MAAAAASLSASQGLLGTSFYGGWGSSISGEDYHTMLAKTTAPRQNFAKLSRKPIRVQPMMKNVNEGKGLFAPLVVVTRNIVGKKRFNQLRGKAIALHSQVITEFCKSIGADAKQRQGLIRLAKKNGERLGFLA

SEQ ID NO: 5435 - DNA, 1126 bp, Zea mays
  misc_feature (1)..(1126): Ceres cDNA ID no. 22005787
  misc_feature (1)..(1126): Ceres CLONE  ID no. 1411238
  misc_feature (1)..(1126): Also known as  Ceres CDNA ID no. 0
gtctgaaactgaaacgctctaagcaaaaatcatcaatgtcgacggaacgagaagtagtctgtgtcaccggcgcaagtggctgcatcgggtcgtggctcgtccatctgctcctcctccgcggctactccgttcacgccaccgtgaaaaacctccaggatgagaaagagacgaaacatctggaagctctcgaaggagcagccacgcgcctccatctattcgagatggatctactgaagtacgacactgtttccgccgccgtcaacggatgttccggcgttttccacctcgcatctccctgtatcgtcgacgaagtccaagatcctcagaagcaactacttgatccagcggttaaggggacattaaatgtactcacggcggcgaaagaagccggcgtgaagagggttgtggtgacgtcttccatatcggcgataaccccaagccccaactggcctgctgataagatcaagaacgaggactgttgggctgatgaagacttctgcaagcaaaatggattgtggtatccactttctaagacgcttgctaagaaggcagcttgggagtttgcagaggagaagggattagatgtggttgtggtgaatccaggaaccgtcatgggtcctgttattcctccatccatcaacgctagcatgctcatgcttcaacgcctccttgaggggtgtacagagacatacgagaacttcttcatgggttcggtgcatttcaaggatgtggcattagctcatatacttgtctatgagaacccatctgctaaaggaagacacctgtgcgttgaggccatctctcactacggtgattttgtagccaaagtagctgaactctatcctaattacagtgtccccaagttaccgagagagactcaaccgggtttactccgagccaagaacgcagcaaagaagctgatggaattggggttagagttcagttccatggaggttatcatcaaggatggtgtggagagtcttaaaagcaaaggatttatctcttaaactcatttgcttgatctagcagtgagcaaattatggtggcagcagaatcatgttatgttatatatataagactttgtaatttgaataagctgcacattgttgtaaaaaaaaaaaaaaaa

SEQ ID NO: 5436 - protein, 323 aa, Zea mays
MSTEREVVCVTGASGCIGSWLVHLLLLRGYSVHATVKNLQDEKETKHLEALEGAATRLHLFEMDLLKYDTVSAAVNGCSGVFHLASPCIVDEVQDPQKQLLDPAVKGTLNVLTAAKEAGVKRVVVTSSISAITPSPNWPADKIKNEDCWADEDFCKQNGLWYPLSKTLAKKAAWEFAEEKGLDVVVVNPGTVMGPVIPPSINASMLMLQRLLEGCTETYENFFMGSVHFKDVALAHILVYENPSAKGRHLCVEAISHYGDFVAKVAELYPNYSVPKLPRETQPGLLRAKNAAKKLMELGLEFSSMEVIIKDGVESLKSKGFIS

SEQ ID NO: 5437 - DNA, 1691 bp, Zea mays
  misc_feature (1)..(1691): Ceres cDNA ID no. 22005788
  misc_feature (1)..(1691): Ceres CLONE  ID no. 1418143
  misc_feature (1)..(1691): Also known as  Ceres CDNA ID no. 24383110
aaattaattaaaaaaaaaaaaaaatgccttctcctccggcgccagaggcggtagtcagccaccgcttcgccgccttcctcatctggcaatcgatcccctcaacagccatcttcctcttcttcaacctcttcctcttctccgccacttccctcgcctccttcctcctcaccttcctcgtcttccacgcctcaaacctcatcttctccatctccctcgctctcctctcctcgccgacctcggactctccccctctctcccctctccaattcgccctcggcctcctccgccgcctctcggatccggacttccgccgccgcgctcgcgtctctttacgaatcgcgctcttcgtctccgccacggggttcgcggggttctgctccgcggctgtgttctgcttggagagtggagtggttgggagagtagggtttagagggtttgtcactggtttgctttacgccgtgctctttgttctcaagcagagatgggtattagagttcccaatcattcagcgtcaaccgttctttagcttcaagattggtctcccttcggcgttaacacaagctttgaagctctctggtgtgctttatgtgttgtcgacggtaatgctgttgtttctgctggactggtctggtgggcttgtgtctgtgtcgaggttcttgggtgagcaggtcatttcttatgcgggtagtttctgtttgatcctctcttgggaagtgactcaccatatacatcaggttctgcacacaaaacgctttgcttttgctcctccaaaaggatctgctgcagcagaaacaaatccaagcgagcctcttctcgctgctctagaagggagtcctccaggttccctcgagcagtatctcgcgtaccttgatctctacatggtgtctcaaaataatgtcgacacctggcgccgcgctgctttcttcgcggagtcaagcgagacttacaaaagagtcatcactctgtgcttgaggcctttagaagagctcgcctccaagttagctgctgggatagaccacacctttgctgaaataggtgaatcatacatcgatcctaaatttggcgaatcactcaagtcgttccagctatatgcatggtgtgctcaaacagccgcatccctcacttcaatctcacacaaggaagacagtctcggagtagcacaactatccggtgcaaacgcagacgttgtctcaaccctcctctctcttctgctagctgttgaaacgtttatggggaagaagaacaatctgcaatcaccgcagcagctcttgggacccgctagcatcaaatgggcgacctcgagcatggtgagaaaagatgttaagccgatcaaaaagagaagcggagcgctctactcttacgcgtacgcagcttcagatgttttgaggatatcgatgtaccagattgtttccacgttccgcgatgagatggtcagcagcgagagaaccgggattcttggtagagattggatcggaagcaagaaaccggtttttggaacgagcgagatgttgttgcagaagcttaagctcttcctagagttccaagcttaaatggaaaatatttaagagagagagaacaaacgagatgttgtgatcaaaacgtgtttgttactttagaaaggacttgtaacgagatctctcatatattatttttttggcagaagttttgggactataaaaaaaaaaaaaaaa

SEQ ID NO: 5438 - protein, 508 aa, Zea mays
  misc_feature: PFam Name: Extensin_2; PFam Description: Extensin-like region
  misc_feature: PFam Name: MSA_2; PFam Description: Merozoite Surface
  misc_feature: PFam Name: Vitellogenin_N; PFam Description: Lipoprotein
  misc_feature: PFam Name: Pyr_redox_2; PFam Description: Pyridine
  misc_feature: PFam Name: Drf_FH1; PFam Description: Formin Homology Region 1
MPSPPAPEAVVSHRFAAFLIWQSIPSTAIFLFFNLFLFSATSLASFLLTFLVFHASNLIFSISLALLSSPTSDSPPLSPLQFALGLLRRLSDPDFRRRARVSLRIALFVSATGFAGFCSAAVFCLESGVVGRVGFRGFVTGLLYAVLFVLKQRWVLEFPIIQRQPFFSFKIGLPSALTQALKLSGVLYVLSTVMLLFLLDWSGGLVSVSRFLGEQVISYAGSFCLILSWEVTHHIHQVLHTKRFAFAPPKGSAAAETNPSEPLLAALEGSPPGSLEQYLAYLDLYMVSQNNVDTWRRAAFFAESSETYKRVITLCLRPLEELASKLAAGIDHTFAEIGESYIDPKFGESLKSFQLYAWCAQTAASLTSISHKEDSLGVAQLSGANADVVSTLLSLLLAVETFMGKKNNLQSPQQLLGPASIKWATSSMVRKDVKPIKKRSGALYSYAYAASDVLRISMYQIVSTFRDEMVSSERTGILGRDWIGSKKPVFGTSEMLLQKLKLFLEFQA

SEQ ID NO: 5439 - DNA, 803 bp, Zea mays
  misc_feature (1)..(803): Ceres cDNA ID no. 22005789
  misc_feature (1)..(803): Ceres CLONE  ID no. 1430607
  misc_feature (1)..(803): Also known as  Ceres CDNA ID no. 0
ataacacacaacttcagctttgaggtaaagcttaaactaaaaaaaaacagaacagagatgggtttggtcacagaggaggtgagagctaaggcagagaagtacaccggagatgagatatgccgagagaagacaaaagtcttcctcaaggaaatatctatgcccaatggtttactaccactgaaggacatagaagaggttgggtacgacagagagtcaggtgttgtgtggctgaagcagaaacagagcatcactcacaagttcgaaacgatcgataagcttgtctcctacggaaccgaggtcacggccgtggttcagacgggtaagatcaagaagctcactggagtcaaggccaaggagcttcttatctgggtcagtgtcagtgagatctatacagaggaaaaggagaagatcacgtttaagaccccaaccacactttccaggactttcccagtctcagcttttgtagtcccagaggaagtggaacctgccaaggaagaacctgccaaggagaagagcagtgaagccgccgccgaggtcaaagaggctgttgcagtcaaggaggcctaatcaaagcttttctacagttaaaagagaccaaaatctattgaagtgtacttcaacaatgtaaacagactattgagagttagtgtttctcactgctcttactctcatgtattacctacccctcgtttctgcatgttttatatgtaataagatgtcaataacatcatcctgttatacaaaaagtaccgtaattatctatagactacattgaagttggttctgtaaaaaaaaaaaaaaaa

SEQ ID NO: 5440 - protein, 169 aa, Zea mays
MGLVTEEVRAKAEKYTGDEICREKTKVFLKEISMPNGLLPLKDIEEVGYDRESGVVWLKQKQSITHKFETIDKLVSYGTEVTAVVQTGKIKKLTGVKAKELLIWVSVSEIYTEEKEKITFKTPTTLSRTFPVSAFVVPEEVEPAKEEPAKEKSSEAAAEVKEAVAVKEA

SEQ ID NO: 5441 - DNA, 1213 bp, Zea mays
  misc_feature (1)..(1213): Ceres cDNA ID no. 22005791
  misc_feature (1)..(1213): Ceres CLONE  ID no. 1432581
  misc_feature (1)..(1213): Also known as  Ceres CDNA ID no. 24397267
aggagaataacgaagcaagatctgccgcgggtccattttaactggtcggcgactccgccgctgccatcttccccctctccccctccgtaccactcgtcttcgtctagcctcccgcccgcagccaccatggcacccggcctctacaccgacatcggcaagaagaccagagatttgctgtacaaggactacaacacgcaccagaagttctccctcaccacctgctcgccccatggcatcgcaatcacagctgcaggaacaaggaaaaatgagtccacctttggcgatcttcacactcaaattaagaacaataaattgacggtcgatgtcaaagcgaactcagaatcagatcttttgacaacaatcactgttgatgagattggtactccagggctcaaatcaattctcactttggttgttccggaccagaggtcagggaagcttgaacttcagtacctacatgaatatactggtgtgaatgcaagcatcgggcttaattccaaccctatggttaacctttctggtgcctttggaagcaaagcactctcagttggcgttgatgtttcatttgatacggagtctagcaatttcactaagtacaatgctgccctgagcctcgccaatccagatcttattgcttcccttcatttgaataaccacggtgataccctggttgcgtcttactaccacctggtaaagcatcattcaggcactgctgttggagctgagctgtctcacagcatctcaagaaatgagagcacactaatatttgggtctcaacactcactggatccccacacgactgtcaaggcacgtttcaacaactatggcatggccagtgcccttgtccagcatgaatggcgtcccaagtcattcatcaccgtctccggtgaggtcgacaccagggcaattgagaagagtacgaaagttggcctgtccttggtgctcaagcactgaaatgctgagtgtttggggctctaggattttattttcgattcggatggattggaataagcatggcctggtgtcatctttgcggcaccgtttggatcttgaattacatattcctctccatgatcaatttcataggaaaatattaggattgattttatgctttaattcccagcgccctgttaataattctggtgattgagacctattgttaagcttgccaaatatgatggtggttattttgtgttcaaaaaaaaaaaaaaaa

SEQ ID NO: 5442 - protein, 275 aa, Zea mays
  misc_feature: PFam Name: Porin_3; PFam Description: Eukaryotic porin
  misc_feature: GI Number: 313136; NR Description: porin [Zea mays] >gi|422030|pir||S34146 porin por1, plastid - maize >gi|1172557|sp|P42057|PORI_MAIZE Outer plastidial membrane protein
  misc_feature: GI Number: 34912192; NR Description: voltage-dependent anion channel [Oryza sativa (japonica cultivar-group)] >gi|18076160|emb|CAC80851.1| voltage-dependent anion channel [Oryza sativa (japonica cultivar-group)]
  misc_feature: GI Number: 558652; NR Description: Voltage dependent anion channel (VDAC) [Triticum aestivum] >gi|2130109|pir||S59547 porin
  misc_feature: GI Number: 5929928; NR Description: voltage-dependent anion
  misc_feature: GI Number: 50899632; NR Description: voltage-dependent anion channel [Oryza sativa (japonica cultivar-group)] gi|7339529|emb|CAB82853.1| voltage-dependent anion channel [Oryza sativa] gi|48716662|dbj|BAD23330.1| voltage-dependent anion
MAPGLYTDIGKKTRDLLYKDYNTHQKFSLTTCSPHGIAITAAGTRKNESTFGDLHTQIKNNKLTVDVKANSESDLLTTITVDEIGTPGLKSILTLVVPDQRSGKLELQYLHEYTGVNASIGLNSNPMVNLSGAFGSKALSVGVDVSFDTESSNFTKYNAALSLANPDLIASLHLNNHGDTLVASYYHLVKHHSGTAVGAELSHSISRNESTLIFGSQHSLDPHTTVKARFNNYGMASALVQHEWRPKSFITVSGEVDTRAIEKSTKVGLSLVLKH

SEQ ID NO: 5443 - DNA, 1176 bp, Zea mays
  misc_feature (1)..(1176): Ceres cDNA ID no. 22005792
  misc_feature (1)..(1176): Ceres CLONE  ID no. 1437288
  misc_feature (1)..(1176): Also known as  Ceres CDNA ID no. 24359675
attcattcatcatccctaaccttaggagttcaacgaaaccctagattcgtcccgtcgaatagcgaagatgctgcgaattgcagggaggaggctattgtctgttcagcagagatcttgtaccgcgaccaccttcgtcctttcccgagatcataccatcgactcctctcccgccgcccccagatctgctccctctgctgatctttcgtctttcaattcttaccaccggagccttataagaggtttagcttctcaagtccttacccaagggaatgaggtaggttttgcttcggaagttccagccacggtggaggcagtcaagacacctaactcaaagattgtgtatgacgaccacaaccatgagcgctacccacctggcgaccctagcaagcgtgccttcgcctatttcgtcctctctggtgggaggtttgtctacgcctctgttctacgccttcttgttctgaagctcattgtcagcatgtccgcaagtaaagatgtccttgcacttgcatccctcgaggttgacctcggtagcatcgaaccaggaacgaccgttacagtgaaatggcgtggaaagcctgtcttcatcaggcgaagaaccgaagatgacatcaagctggccaatagtgtggatcttggttctctgagagaccctcaagaagatgctgtcagggtcaagaatccggaatggttagtggtggttggtgtctgcactcacttgggatgcatccccttgcctaacgctggtgattatggaggttggttctgcccctgtcacggatcacattacgatatctctggaaggatcaggaaaggtcctgcaccgtacaacctggaagtgccaacatacagcttcttggaagagaacaagttactaattggttgatgaataaaagcacaacaggtaggtcacacactgtctgtgtcttaaagatcttcacttgattttgtttttcttttatatatatttcggctaaaatgttagctcgcaagttatctctttcctcacactttggtctctctcagcaagtaaaagatcgtcttgtttcgatgaataaatcaaaacttgtcactgtatgactgagcatctttatctcatctggtaataaaacactgttcataagtatgtgtttattgtttaaaaagaattttggattttgaataaaaaaaaaaaaaaaa

SEQ ID NO: 5444 - protein, 271 aa, Zea mays
MLRIAGRRLLSVQQRSCTATTFVLSRDHTIDSSPAAPRSAPSADLSSFNSYHRSLIRGLASQVLTQGNEVGFASEVPATVEAVKTPNSKIVYDDHNHERYPPGDPSKRAFAYFVLSGGRFVYASVLRLLVLKLIVSMSASKDVLALASLEVDLGSIEPGTTVTVKWRGKPVFIRRRTEDDIKLANSVDLGSLRDPQEDAVRVKNPEWLVVVGVCTHLGCIPLPNAGDYGGWFCPCHGSHYDISGRIRKGPAPYNLEVPTYSFLEENKLLIG

SEQ ID NO: 5445 - DNA, 625 bp, Zea mays
  misc_feature (1)..(625): Ceres cDNA ID no. 22005794
  misc_feature (1)..(625): Ceres CLONE  ID no. 1442901
  misc_feature (1)..(625): Also known as  Ceres CDNA ID no. 24397310
aaaaggaaggcttgtgttgtgtttggctagggtttgctcgcgtctcctccttcccttggctgctgtcgtgctggtcggcggcgacagcaagggagggaacatgtcgaagaagaacaatcttgccaagaggaagaagcagtacgagttcgacctccaacgggagaaggaggccaaggagaagcaggccaagaagctgcaagccaagaaatccaagatgaagatagatggtgctgaaaagaaacgtaaaggtggccaatttaaggtcggcaagaaaaaggtgaagacgaaactttcagccttagcaaaagccaaagccgcgcaagccatggaggtcgacaagtgactgcggagcacaagcatcatcaccttaagcgtcgagccagagttggaactctgaattctgtgcccacatgaatagctcccgtcgggtgcagctgcagctgcagcttgttgaacctttctttctaaaaagaatgtcattcttgcttttttaagggtaatcaagctctagttataggttttggtgataacgactatgatgttagagaactaatgagatttatggagctaaatgaaaaagagaaaaatacatgtgatttttgatgcttcaaaaaaaaaaaaaaaa

SEQ ID NO: 5446 - protein, 625 aa, Zea mays
AAAAGGAAGGCTTGTGTTGTGTTTGGCTAGGGTTTGCTCGCGTCTCCTCCTTCCCTTGGCTGCTGTCGTGCTGGTCGGCGGCGACAGCAAGGGAGGGAACATGTCGAAGAAGAACAATCTTGCCAAGAGGAAGAAGCAGTACGAGTTCGACCTCCAACGGGAGAAGGAGGCCAAGGAGAAGCAGGCCAAGAAGCTGCAAGCCAAGAAATCCAAGATGAAGATAGATGGTGCTGAAAAGAAACGTAAAGGTGGCCAATTTAAGGTCGGCAAGAAAAAGGTGAAGACGAAACTTTCAGCCTTAGCAAAAGCCAAAGCCGCGCAAGCCATGGAGGTCGACAAGTGACTGCGGAGCACAAGCATCATCACCTTAAGCGTCGAGCCAGAGTTGGAACTCTGAATTCTGTGCCCACATGAATAGCTCCCGTCGGGTGCAGCTGCAGCTGCAGCTTGTTGAACCTTTCTTTCTAAAAAGAATGTCATTCTTGCTTTTTTAAGGGTAATCAAGCTCTAGTTATAGGTTTTGGTGATAACGACTATGATGTTAGAGAACTAATGAGATTTATGGAGCTAAATGAAAAAGAGAAAAATACATGTGATTTTTGATGCTTCAAAAAAAAAAAAAAAA

SEQ ID NO: 5447 - DNA, 1410 bp, Zea mays
  misc_feature (1)..(1410): Ceres cDNA ID no. 22005795
  misc_feature (1)..(1410): Ceres CLONE  ID no. 1444852
  misc_feature (1)..(1410): Also known as  Ceres CDNA ID no. 24359771
acaccaatttgtttcctgaggttcggttccaatgaacctactccccgttgaggaggccatgaaggcgggtctttgtcaaccctttccctctctcaaacgatcacttagaccggatgagtgcttcttcttaatctcaacaatcaccaagaccccgcaaggatcaccagacacttaggtgtctcttgctagctttacaagtcactatagagtttagaaagagaagaagaaagcacgattaaaagcccagcaacaagagcaacaaatagacacgaatcactctctctcaagtcactaatcactaatgatcacttgtcttaattgtggcacttggagtgattggaagctttaaatgtgtcttggaatggattgctagcttttgtattgaatgtgtatgagtagaatgcttggatgtgttgaatggaggtggttggggttgtatttatagccaccaaccacttcctagccattgcctccttcctgctaaccgtggacggtccgcgcccctggcccggacggtccgcccctacacatcaatggctgaaatcgcaatggtcaatagtaacggctatatcaatggctacaatacatttaatgtgttgttagatgtcagataaagcagtcgcagatggtccgtccgtgcaccccggacggtctgcgaggacgctaaaatgcattttaccaaacccgtcacctttgggtttttctggtttttcaacgactagactgtccacgcctaaggccggatgatccgagcttggtcctgaacggtgctcgcctctctttcggatagtccgtagtaataacacgtgtttttgcagtgttcctgtccgaggatcaccctgttgtcgcggacggtccgccgcaagggcccggacggtccgcgcacaagtgaatttccaaaactcttctctagtctggaataatctacaatattgatgtatatgaactttatgcacctgagaaatgatcagctaggcaaactagttagtccatgagatttgtgatgggcgtcaaacaccaaaatcgattatatgaaatggttaaggacatttcctttcagctctctcctctctccctcgctcttccgcgtcgaccggagccgtccgccgccgaccgccttccacggagctcgccggagcccctccccggtcgcgccctgcgccctcaccgccgactgcctgagcttgccgatgacctcctagccacacccacgccaaccgtgcccctgctcgccttggccgaccccccattcttcgatttcatcactgcacagagacctatgagcaaggttgaagacaacacaaatttttattttcaaaatcatgtttgatttagttcatgatttctgtaactatttgtcttaatttgtatatactgtgatttggagatcatgtaaaaaaaaaaaaaaaa

SEQ ID NO: 5448 - protein, 1410 aa, Zea mays
ACACCAATTTGTTTCCTGAGGTTCGGTTCCAATGAACCTACTCCCCGTTGAGGAGGCCATGAAGGCGGGTCTTTGTCAACCCTTTCCCTCTCTCAAACGATCACTTAGACCGGATGAGTGCTTCTTCTTAATCTCAACAATCACCAAGACCCCGCAAGGATCACCAGACACTTAGGTGTCTCTTGCTAGCTTTACAAGTCACTATAGAGTTTAGAAAGAGAAGAAGAAAGCACGATTAAAAGCCCAGCAACAAGAGCAACAAATAGACACGAATCACTCTCTCTCAAGTCACTAATCACTAATGATCACTTGTCTTAATTGTGGCACTTGGAGTGATTGGAAGCTTTAAATGTGTCTTGGAATGGATTGCTAGCTTTTGTATTGAATGTGTATGAGTAGAATGCTTGGATGTGTTGAATGGAGGTGGTTGGGGTTGTATTTATAGCCACCAACCACTTCCTAGCCATTGCCTCCTTCCTGCTAACCGTGGACGGTCCGCGCCCCTGGCCCGGACGGTCCGCCCCTACACATCAATGGCTGAAATCGCAATGGTCAATAGTAACGGCTATATCAATGGCTACAATACATTTAATGTGTTGTTAGATGTCAGATAAAGCAGTCGCAGATGGTCCGTCCGTGCACCCCGGACGGTCTGCGAGGACGCTAAAATGCATTTTACCAAACCCGTCACCTTTGGGTTTTTCTGGTTTTTCAACGACTAGACTGTCCACGCCTAAGGCCGGATGATCCGAGCTTGGTCCTGAACGGTGCTCGCCTCTCTTTCGGATAGTCCGTAGTAATAACACGTGTTTTTGCAGTGTTCCTGTCCGAGGATCACCCTGTTGTCGCGGACGGTCCGCCGCAAGGGCCCGGACGGTCCGCGCACAAGTGAATTTCCAAAACTCTTCTCTAGTCTGGAATAATCTACAATATTGATGTATATGAACTTTATGCACCTGAGAAATGATCAGCTAGGCAAACTAGTTAGTCCATGAGATTTGTGATGGGCGTCAAACACCAAAATCGATTATATGAAATGGTTAAGGACATTTCCTTTCAGCTCTCTCCTCTCTCCCTCGCTCTTCCGCGTCGACCGGAGCCGTCCGCCGCCGACCGCCTTCCACGGAGCTCGCCGGAGCCCCTCCCCGGTCGCGCCCTGCGCCCTCACCGCCGACTGCCTGAGCTTGCCGATGACCTCCTAGCCACACCCACGCCAACCGTGCCCCTGCTCGCCTTGGCCGACCCCCCATTCTTCGATTTCATCACTGCACAGAGACCTATGAGCAAGGTTGAAGACAACACAAATTTTTATTTTCAAAATCATGTTTGATTTAGTTCATGATTTCTGTAACTATTTGTCTTAATTTGTATATACTGTGATTTGGAGATCATGTAAAAAAAAAAAAAAAA

SEQ ID NO: 5449 - DNA, 1067 bp, Zea mays
  misc_feature (1)..(1067): Ceres cDNA ID no. 22005796
  misc_feature (1)..(1067): Ceres CLONE  ID no. 1445958
  misc_feature (1)..(1067): Also known as  Ceres CDNA ID no. 24397343
accaccgctccagcctcctctagagccttcgccgcttcgcgcctcggcggcaatcatcggatcggaacctgcacaagtagaagtacgcaacaagccttgccactaacatgccttcagtcgaggtcgaggtccaggtgggcggcgccggcgggtggaggccgaagcagcagcaccaccatccccttgagatccgtcaggtgtgggcggacaacgtggaccgcgaattcaagctcatccgcgccgccatcgagcggttcccctacgtgtccatggacacggagttcccgggcgtcatccaccaccctcccccggccgtccaccactccacgctcaccgcgccgcagcgctacgccctgctcaagtccaacgtcgacgcgctgcacctcatccaggtcggcctggccctggcgccgtcccctggctccccgcccgcgctcgccttccagatcaacctccgcggcttcgacccgcgcgtgcaccgccacgcgccggactcggtccgcctgctcgccgccagcggcctcgacctcgccgcccaccgcgccaggggcgtccccgcgcgcgccttcgccgcgctgctcgcctcgtcgggccttatctgcaacccggccgtcgcgtgggtcatcttcagctccgcctatgacttcgcctacctcgtcaagctgctcatgggacggaagctgccaagggcgctcccggacttcctgcgatacgtccgcgtctacttcggcgccgccgtctacgacgtcaagcacatggccagggtcgcatgcgcctcccacggcgaggtcgcgctgctgggcggcctcgagcgcgtcgccgccgcgctccgggtgcgccgcgcagcgggccaaggacaccaggcagcgtccgacagcgtgctcacctgggacactttccgggagatggctaggatctacttccccaaggaaggcagcctggagccgtgcgccggcgtgctctacggcctcgagctcccaaactgaattcttcttgttcgtgtacagtacacagcctcccaaacgaagaaataacgattctttgattacttaaaaaaaaaaaaaaaa

SEQ ID NO: 5450 - protein, 292 aa, Zea mays
  misc_feature: PFam Name: CAF1; PFam Description: CAF1 family ribonuclease
  misc_feature: PFam Name: Peptidase_S8; PFam Description: Subtilase family
  misc_feature: PFam Name: Cytadhesin_P30; PFam Description: Cytadhesin P30/P32
  misc_feature: GI Number: 17381058; NR Description: putative CCR4-associated factor [Arabidopsis thaliana] >gi|9757805|dbj|BAB08323.1| CCR4-associated factor-like protein [Arabidopsis thaliana] >gi|25054979|gb|AAN71961.1| putative CCR4-associated factor
  misc_feature: GI Number: 21436313; NR Description: putative CCR4-associated factor 1 [Arabidopsis thaliana] >gi|15292829|gb|AAK92783.1| putative CCR4-associated factor 1 [Arabidopsis thaliana] >gi|7649377|emb|CAB88994.1| CCR4-associated factor 1-like protein
  misc_feature: GI Number: 55296464; NR Description: putative CCR4-associated
  misc_feature: GI Number: 50934437; NR Description: putative CCR4-NOT transcription complex,subunit 7 [Oryza sativa (japonica cultivar-group)] >gi|50509734|dbj|BAD31786.1| putative CCR4-NOT transcription complex,subunit 7 [Oryza sativa (japonica
  misc_feature: GI Number: 51964484; NR Description: PREDICTED OJ1695_H09.27-1 gene product [Oryza sativa (japonica
MPSVEVEVQVGGAGGWRPKQQHHHPLEIRQVWADNVDREFKLIRAAIERFPYVSMDTEFPGVIHHPPPAVHHSTLTAPQRYALLKSNVDALHLIQVGLALAPSPGSPPALAFQINLRGFDPRVHRHAPDSVRLLAASGLDLAAHRARGVPARAFAALLASSGLICNPAVAWVIFSSAYDFAYLVKLLMGRKLPRALPDFLRYVRVYFGAAVYDVKHMARVACASHGEVALLGGLERVAAALRVRRAAGQGHQAASDSVLTWDTFREMARIYFPKEGSLEPCAGVLYGLELPN

SEQ ID NO: 5451 - DNA, 1372 bp, Zea mays
  misc_feature (1)..(1372): Ceres cDNA ID no. 22005799
  misc_feature (1)..(1372): Ceres CLONE  ID no. 1450278
  misc_feature (1)..(1372): Also known as  Ceres CDNA ID no. 24397432
atcaaatctttcttgttcccttctctctctctctctcttccaaaaatctctcctttatccccgcaaagaaccaaaataataaaaaaaaaaactcactctttctttgattcatcacactcgactaatgtcgccggcaacagaacttaacggctcgttcctcagccgactcagcttccgccgcaaccagatcgtctcaatggacgtcaaccacgagcaacagctccaagaactcgagtatttcaagaaccacgtctccgagcgtttctcagagttcatctctccatcgccgccgtcggatccaattctctcgatcccctggctacggaacctcctccacgttttcatctcctgcgaaacggagttcaaagaagtcctcccgaccacggctcagatctcgaaaacgccgtcgctggagaaggttttgtcggaaatgctcgatcggatcttaaagtcgctcgatatctgtaacgccgtcgttaacggcatcgaatccgttaaacagagccggcgtcttgcggagatagccgtaacggcgcttaaacaacggccgttatgtagcgggagcgttcgcagagccaaacgcgcgttaacaagcctcctcgttagcttaaacgccgatgtgaaagataggaacagtggtggtggaagtagtagacggaggataacttcgcggtcgtggtcgtttggacagcgcagcagccacgtcggcaagaattggtctgcagccaagcagattcaagcgatggtggctaatcttgtgctcccacgtggagcagaagcgatgccggtttacataatgagcagtgttatggttttggtgatgtgggtgcttgttgcggcggttccttgccagacaagcagcgttcctgtggcgccgttgcagcttcctaagcatcagagctgggctagcaatgctgtgaatgttcaggagagggttggtgaagaggtgaaacggaaggagaagcgtgggggtgggttgatggaggagatgcagaggatggagagtgttgggttgtttttgatggagttcacggagaggtttatgtttccgggagaggaagaggaagaggtcgaggagaaggttgatgagatggatgagatttgtcggagaatggaagtggaattggaggatttgcagagacaagtgagggcagtgttccaaagattgataagactaatcttttgaagatcttgatgtgtataagaagctttcctatgtttcttaccggggcgctttggttctgttctgcttccattagtgtctgaagcaggtgtgtattgttgatgtgtgctcttctgtcagctatttctttcaatgtatgcaactcaagatctttaagaaaatttacagagagcaaaaaaaaaaaaaaaa

SEQ ID NO: 5452 - protein, 353 aa, Zea mays
  misc_feature: GI Number: 21553882; NR Description: unknown [Arabidopsis thaliana]
  misc_feature: GI Number: 21593634; NR Description: unknown [Arabidopsis thaliana]
  misc_feature: GI Number: 21536674; NR Description: unknown [Arabidopsis thaliana]
  misc_feature: GI Number: 62732989; NR Description: CAA303718.1 protein
MSPATELNGSFLSRLSFRRNQIVSMDVNHEQQLQELEYFKNHVSERFSEFISPSPPSDPILSIPWLRNLLHVFISCETEFKEVLPTTAQISKTPSLEKVLSEMLDRILKSLDICNAVVNGIESVKQSRRLAEIAVTALKQRPLCSGSVRRAKRALTSLLVSLNADVKDRNSGGGSSRRRITSRSWSFGQRSSHVGKNWSAAKQIQAMVANLVLPRGAEAMPVYIMSSVMVLVMWVLVAAVPCQTSSVPVAPLQLPKHQSWASNAVNVQERVGEEVKRKEKRGGGLMEEMQRMESVGLFLMEFTERFMFPGEEEEEVEEKVDEMDEICRRMEVELEDLQRQVRAVFQRLIRLIF

SEQ ID NO: 5453 - DNA, 1615 bp, Zea mays
  misc_feature (1)..(1615): Ceres cDNA ID no. 22005800
  misc_feature (1)..(1615): Ceres CLONE  ID no. 1450895
  misc_feature (1)..(1615): Also known as  Ceres CDNA ID no. 24359755
gtaactcctgtcgtctagcgcgaggaggagccgtgttgccgtgcacccagcccagtgccgatggctcccagtcccagatccgtccatgcccggttcctttcgttttccctgacacggttccaactcttctttccctggaactggaacgcaccgcatccgatgggtcggcgcctgggcccccgtgcccgcgcatcgtataaagccgcccctccgccacccgaccttgccgcgtctcccgtgatccccgtctccagctcaggagccagccacagcccacagctattcatcagcttgacctccccgtccgcccgcccgcccgcttctcgcgtcgaggtcggccgcgcgccactctgaatccccagggcaccacaccgccggacaacctcgagaagaagcaccggcaacgacgacgagctagcactagcagtcagtcacagccgggcaaggattcacaccgttgagtgcatgcagattgattcggacgagcagccgatgatgatgcacgggaacgggcacgggcacggccgtgtccacccggcgtcctccagctccgacttctccggcgagatgaaccagtcggccgtgtccgacccctcctctagcccgctctacagcttccacttcgagaagcccgtcccgccgccgccgccgcagcagcagcccgcaggcacgtacgtggtgcaggtgcccaaggacaaggtcttccgcgtcccgccgcccgagaacgcgcgcctcttcgaccactacacgcgccgcgccaggcgccgccgccgcggcagctgctcctgcgcgtgcctgctcgtcggagccgcagtcgcgctcgccgccgccctcgccggcgtcctcgcgtgcctggtcctcgggccgaagccgccggcgtacgcggtccaggcgctggccgtctccggtctcgtcaacgcctccgcctccgcctcctcctccccggccgcgctctcgccggggttcgacgcgaccgtgcgcgccgacaaccgcaacggcaggctcggcgtgcggtacgaggggggccggggccgcgtctccgtgtcgtacggcggcgcgctcctggccgacggcgcgtggccggcgctctaccaggctccccggaacgtgacggtggtcgtggcgagggcgagggggtccggggtacggctgtcgcggagcgtgcgagggcagttggccgcggcggaacggctccggtcggtgccgttcgacatggacgtcgacgtgcccgtgcgcctccagctcggcgtggtcaggacgtgggccgtgccgctgcgggcgcgctgcaccgtggcggtcgacaggctcgcggccgacgccagggtggtgtccaactcgtgcgacgtcaaggtgcgcctcctgtcgtggtggaggaactgacgatggcgccatggtggcggattacatacttgagcacttcttgtttggttttaggatgcgttttcccctcatttgtaagctggtttggttccccaatatggatcttgtcatcgtagtatcatatcaggaacgctgtcaaatcgtcttgcgactaatgtcatgttggtgagttgctcaagagtcgagactgaagaattgactaatgttttgttcaagtgcaaaaaaaaaaaaaaaa

SEQ ID NO: 5454 - protein, 304 aa, Zea mays
  misc_feature: PFam Name: Hin1; PFam Description: Harpin-induced protein 1 (Hin1)
  misc_feature: PFam Name: FH2; PFam Description: Formin Homology 2 Domain
  misc_feature: PFam Name: APC_basic; PFam Description: APC basic domain
  misc_feature: PFam Name: Peptidase_S8; PFam Description: Subtilase family
  misc_feature: PFam Name: Pyr_redox_2; PFam Description: Pyridine
  misc_feature: GI Number: 34909192; NR Description: P0425G02.19 [Oryza sativa (japonica cultivar-group)] >gi|18844773|dbj|BAB85244.1| P0425G02.19 [Oryza sativa (japonica cultivar-group)] >gi|20161461|dbj|BAB90385.1| P0432B10.3 [Oryza sativa (japonica
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 15239459; NR Description: harpin-induced protein-related / HIN1-related / harpin-responsive protein-related
  misc_feature: GI Number: 21554256; NR Description: unknown [Arabidopsis thaliana] >gi|18408342|ref|NP_564862.1| harpin-induced protein-related / HIN1-related / harpin-responsive protein-related
  misc_feature: GI Number: 6686408; NR Description: F1E22.7 [Arabidopsis thaliana]
MQIDSDEQPMMMHGNGHGHGRVHPASSSSDFSGEMNQSAVSDPSSSPLYSFHFEKPVPPPPPQQQPAGTYVVQVPKDKVFRVPPPENARLFDHYTRRARRRRRGSCSCACLLVGAAVALAAALAGVLACLVLGPKPPAYAVQALAVSGLVNASASASSSPAALSPGFDATVRADNRNGRLGVRYEGGRGRVSVSYGGALLADGAWPALYQAPRNVTVVVARARGSGVRLSRSVRGQLAAAERLRSVPFDMDVDVPVRLQLGVVRTWAVPLRARCTVAVDRLAADARVVSNSCDVKVRLLSWWRN

SEQ ID NO: 5455 - DNA, 1674 bp, Zea mays
  misc_feature (1)..(1674): Ceres cDNA ID no. 22005802
  misc_feature (1)..(1674): Ceres CLONE  ID no. 1453556
  misc_feature (1)..(1674): Also known as  Ceres CDNA ID no. 23862702
tcctttcttttgtataaaaaacacccgcctccgtctccatctccggtgagcaggaagagggggagggaggaggccaagagcgcagcggcgaagccatagccaagctcacccgatccagtccctgccgcccccagcgtgccacagccagtcccgcgctcagctcagctcagattcacgagctcgtctcccagatccagcttcgtttggttgaattctcttctttggaagtgctggtgggcggcgtggtttggtgctcttggggccggcgtgtttctgcgttctccgggctatctgcctgtcttgctgcggcctgcggcggcggggtggagatgggggtggccggggagaagttccagctggggacggtgggggcgctcagcctctcggtggtgtcctccgtctccatcgtcatctgcaacaaggctctcatgagctccctccgcttcaactttgccaccactttgacaagctggcatcttctggtcaccttctgttctctccatgtagcattatgtatgaaactctttgagcacaaacctttcgatgcaaggaccgtcatgggattcggagtgctcaatggcatatcgattggacttcttaacttgagtttgggtttcaattctgttggtttctatcagatgacaaagctggctattattccctgtactgttatactggagacccttttcttcaggaagaaatttagtcggaacatcaagctttcccttagtgtgctccttcttggtgttggtgttgcaactataactgatctgcaactcaaccttgtgggatctgtattgtccctactggcaatcatcacaacctgcattgctcagatcatgacaaatacaatacagaagaagttcaaggtatcttcgacacagctcctgtaccaatcgtgcccataccaagcattgactttgttcctcgtcggcccattccttgatgggtttttgactaaccaaaacgtctttgctttcgactacacaactcaagtcctgttcttcatcgtgctgtcgtgcctgatctcggtctcggtaaacttcagcactttccttgtgatcgggaagacgtcgcctgtaacctaccaagttctcggccacctgaaaacgtgcttggtcctcgccttcggctacgtcctgctccacgacctgtttagctggagaaacatacttggaatcctgatcgcggtgatcgggatggttctgtactcgtacttctgcactagagagactcagcagaagccggcagaggcctccccgcaagccatccaggcaaaggagggtgaatcgagccctctgatcttggattccctgagcgccgctgaaaacgggggcagtgccaccgacgacgagcctctgaaggtgccaatgtggagctcgaagtactccaaggcgtgaaaggctgttctgttactggtgtactacggcgctatacagaatccagcttggtaggcagataccatactactactagggttggaaggcaatcctgttcctgttcatgttccatttttggccttctatttttttcttttcttgttttcttcctttctggcatatactacaaatatatgtgctgctggtgctgttagtaaatggatctcactcttgggaggatgatacctcagctcgagacgagtgatctgtctgaaagccaaaaaaaaaaaaaaaa

SEQ ID NO: 5456 - protein, 356 aa, Zea mays
  misc_feature: GI Number: 30984584; NR Description: At2g30460 [Arabidopsis thaliana] >gi|27311731|gb|AAO00831.1| putative integral membrane protein [Arabidopsis thaliana] >gi|51970690|dbj|BAD44037.1| integral membrane protein -like [Arabidopsis thaliana]
  misc_feature: GI Number: 13699188; NR Description: putative
  misc_feature: GI Number: 50910741; NR Description: phosphate translocator-like [Oryza sativa (japonica cultivar-group)] >gi|48717036|dbj|BAD23725.1| phosphate translocator-like [Oryza
  misc_feature: GI Number: 13384378; NR Description: putative phosphate
  misc_feature: GI Number: 42570326; NR Description: transporter-related
MGVAGEKFQLGTVGALSLSVVSSVSIVICNKALMSSLRFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATITDLQLNLVGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLAFGYVLLHDLFSWRNILGILIAVIGMVLYSYFCTRETQQKPAEASPQAIQAKEGESSPLILDSLSAAENGGSATDDEPLKVPMWSSKYSKA

SEQ ID NO: 5457 - DNA, 806 bp, Zea mays
  misc_feature (1)..(806): Ceres cDNA ID no. 22005803
  misc_feature (1)..(806): Ceres CLONE  ID no. 1457882
  misc_feature (1)..(806): Also known as  Ceres CDNA ID no. 24360772
gacagtaacctggtggttgggaggctgagattcgatggcgacgaggctgaaatcgatgacgactttgccaaaactaattcaaaccatgagaaaggaagctcctaagcattgtaatccagtgttgccatcgttaagacgagctttctccctctacgaccagatcaatctcattgacaatgtccccgaagaccagctccgcttccaagagtttaatgagacgagcttcacggtgaatggggtcaaatacgaaggtagcttactctgtgtcgggaacttgcttatgtcgtggagccctcgtcaattctccgacatcacccctgatagcttgtctatcttccagacggttcgacccattccagagctcttaattgttggttgtggaagaaacattcaccctgtaactcccgagctccgtcagtttgtgaagtctattggcatgaagctagaaaccgttgattctagaaacgctgcatcaacttacaacattctgaatgaagaaggaagggtcgttgctgctgcattgcttccttatggagttacatcttaaggaattaaaaaaaaaacggctaccaattcgagctcggtctgtataaccttgtagatgagtgttgagacttcatctcttgtgaaaataaaccgaaattaatcggctttttttcttgcttcttgagcttaataacattgtaacaaacacacatgaccggttctgagatttatggaaatttgaaatagttacagtttgtaacaaacagaaactttaattgcatttctcacttttcaaaaaaaaaaaaaaaaaaaaaaaaaaa

SEQ ID NO: 5458 - protein, 170 aa, Zea mays
  misc_feature: PFam Name: Extensin_2; PFam Description: Extensin-like region
  misc_feature: PFam Name: Atrophin-1; PFam Description: Atrophin-1 family
  misc_feature: PFam Name: Drf_FH1; PFam Description: Formin Homology Region 1
  misc_feature: PFam Name: FH2; PFam Description: Formin Homology 2 Domain
  misc_feature: GI Number: 34903646; NR Description: B1015E06.6 [Oryza sativa (japonica cultivar-group)] >gi|20804513|dbj|BAB92207.1| B1015E06.6
  misc_feature: GI Number: 6630459; NR Description: F23N19.12 [Arabidopsis thaliana] >gi|30696750|ref|NP_176463.2| invertase/pectin
  misc_feature: GI Number: 21992; NR Description: extensin [Volvox carteri]
  misc_feature: GI Number: 33150824; NR Description: Ser/Arg-related nuclear matrix protein [Homo sapiens] >gi|3005587|gb|AAC09321.1|
  misc_feature: GI Number: 23274133; NR Description: Serine/arginine
MATRLKSMTTLPKLIQTMRKEAPKHCNPVLPSLRRAFSLYDQINLIDNVPEDQLRFQEFNETSFTVNGVKYEGSLLCVGNLLMSWSPRQFSDITPDSLSIFQTVRPIPELLIVGCGRNIHPVTPELRQFVKSIGMKLETVDSRNAASTYNILNEEGRVVAAALLPYGVTS

SEQ ID NO: 5459 - DNA, 1196 bp, Zea mays
  misc_feature (1)..(1196): Ceres cDNA ID no. 22005804
  misc_feature (1)..(1196): Ceres CLONE  ID no. 1457989
  misc_feature (1)..(1196): Also known as  Ceres CDNA ID no. 24390951
aattatgcctccactccattaggttcgccctgtgtcggtcatccctctccccttctcttctattcctgcgtccctttccacaacgctgtctcgttctctagctcactagctttgaccgttttccaggctctagccacccctgtgtcccccagcgatcccccaccatgggctcccactcccacctcggccaagcactacaagcccaccaccaccaccaccaccaccaccgcggcggcgagtgcgagccagcgacggcggcggcggcgaggtcgcggtgggcgcccaagccggagcagatcctgatcctggagtccatcttcaacagcggcatggtgaacccggccaaggacgagacggcgcgcatccgccgcctgctcgagcgcttcggcgccgtccgcgacgccaacgtcttctactggttccagaaccgccggtcccggtcgcggcgccgcgcccgccagctgcagcagcagcaggccggctcgggcccgcagcacccaaccgccgccgcagccgccggccacgtccacggcgccaacgccaacgacggcgtgtcactctacgccatgcacaggcacgctggccagcagcagcaggcgcgcgccgccggcctgcccgcggtcgcgccggtggtgctgccgcctgccgccgtcgcgtcgtcgccccgcttcttcggcgacgaaatcgatactgacggcggggacgacctcttcgccatctcccggcaaatggggctcatgtcgcgcggcggcgagcagcatggttgcggctacgtggctaacaacgacgcctcccagtcccacctgctgagctaccaaccaactgggacggcgacgacggcggcggcggcgtatatccaggtgtccatcaacggcgtggtgtacgaggtgccaggcgccggggcattgctggacttggcaggcacgttcgggcgcgatgcgatgctggtccactcctccggcgagatcctaccggtgaacgagaacggcgtcctcatgaagagcttgcagatgggggaatgctactacctggtttcgaaatctacttaataaccagctgctgcttgttgcctgctgctgcgtattatgatgatttgagtaatgtgctagtaagaagcatgtaacgacaattgatgagtagattgttaagtcgtccatatgttatactatcttagttctcgaaaaaaaaaaaaaaaa

SEQ ID NO: 5460 - protein, 294 aa, Zea mays
  misc_feature: PFam Name: Homeobox; PFam Description: Homeobox domain
  misc_feature: PFam Name: FH2; PFam Description: Formin Homology 2 Domain
  misc_feature: PFam Name: Drf_FH1; PFam Description: Formin Homology Region 1
  misc_feature: PFam Name: 7tm_1; PFam Description: 7 transmembrane receptor
  misc_feature: GI Number: 50942791; NR Description: putative homeodomain protein [Oryza sativa (japonica cultivar-group)] >gi|40253638|dbj|BAD05582.1| putative homeodomain protein [Oryza
  misc_feature: GI Number: 37955223; NR Description: WOX11 protein
  misc_feature: GI Number: 37955180; NR Description: WOX8 protein
  misc_feature: GI Number: 2253582; NR Description: putative homeodomain transcription factor [Arabidopsis thaliana] >gi|25408317|pir||G84750 probable homeodomain transcription factor
  misc_feature: GI Number: 50508276; NR Description: putative homeodomain
MGSHSHLGQALQAHHHHHHHHRGGECEPATAAAARSRWAPKPEQILILESIFNSGMVNPAKDETARIRRLLERFGAVRDANVFYWFQNRRSRSRRRARQLQQQQAGSGPQHPTAAAAAGHVHGANANDGVSLYAMHRHAGQQQQARAAGLPAVAPVVLPPAAVASSPRFFGDEIDTDGGDDLFAISRQMGLMSRGGEQHGCGYVANNDASQSHLLSYQPTGTATTAAAAYIQVSINGVVYEVPGAGALLDLAGTFGRDAMLVHSSGEILPVNENGVLMKSLQMGECYYLVSKST

SEQ ID NO: 5461 - DNA, 850 bp, Zea mays
  misc_feature (1)..(850): Ceres cDNA ID no. 22005810
  misc_feature (1)..(850): Ceres CLONE  ID no. 1469409
  misc_feature (1)..(850): Also known as  Ceres CDNA ID no. 24390709
aaggactactccatacaaattaaacgaagcacgacgacatccacacgtcgacaaagtaagcggctacagtatatagtgtcagtccaccacgatggcccccaatggagaatcaccggccatgaccgccgtggcgccgctcctggcgacgatcttcggcggcgagcacaggcggcagagggtcccgtcgtcccacgagctccgcagctgcgtggcgggcgaccaccaccaccacaaggaaacggagctggccagccccgccggcgacgacccgagggacgccgcagcgcgcccgccggcggaggtggaggacgcggagtgcgagtgctgcggcatgtcggaggagtgcaccccgtcgtacatcgccgcggtgcgccgccgcttctcggggcgctgggtgtgcggcctgtgcgccgaggccgtggccgaggaggccgccaagaacggcggcgaccgcgcggccgcgctggcggcgcacatggccgtctgccgccgcttcaacggcttcgggaggacgcacccggcgctcttccaggccggcgccgtgatcggcatcgtcaggaagctctccgggtcgccgggcccaaggtcgcccaagtctagcgctgctggcacgaggccggtcgtcatcagtgacggcgccgtcgacggcagctccggctgcaggtcgctcgtggccggcgtacgcaacggtcaggtggtcaccaactagatcgctggctgaatagctccgtttgcgaattcagggtttatataggtaggtacaccatgtggcatgattgatttgtttccaggtgcagtgcctgttggatgggcttttgtttacttctttcagctcttttaaaaaaaaaaa

SEQ ID NO: 5462 - protein, 205 aa, Zea mays
  misc_feature: GI Number: 34903632; NR Description: B1046G12.23 [Oryza sativa (japonica cultivar-group)] >gi|20160472|dbj|BAB89425.1|
  misc_feature: GI Number: 7715593; NR Description: F20B17.20 [Arabidopsis
  misc_feature: GI Number: 21555605; NR Description: unknown [Arabidopsis thaliana]
  misc_feature: GI Number: 34903640; NR Description: B1015E06.3 [Oryza sativa (japonica cultivar-group)] >gi|20804510|dbj|BAB92204.1| B1015E06.3
  misc_feature: GI Number: 34909436; NR Description: OSJNBa0014K08.12 [Oryza sativa (japonica cultivar-group)] >gi|21902038|dbj|BAC05587.1|
MAPNGESPAMTAVAPLLATIFGGEHRRQRVPSSHELRSCVAGDHHHHKETELASPAGDDPRDAAARPPAEVEDAECECCGMSEECTPSYIAAVRRRFSGRWVCGLCAEAVAEEAAKNGGDRAAALAAHMAVCRRFNGFGRTHPALFQAGAVIGIVRKLSGSPGPRSPKSSAAGTRPVVISDGAVDGSSGCRSLVAGVRNGQVVTN

SEQ ID NO: 5463 - DNA, 734 bp, Zea mays
  misc_feature (1)..(734): Ceres cDNA ID no. 22005812
  misc_feature (1)..(734): Ceres CLONE  ID no. 1469452
  misc_feature (1)..(734): Also known as  Ceres CDNA ID no. 23842215
aagcccatgccgggtgccatctctccttcctcgaggtcgaggacgaaagccagtcacgtgcattgagcttgaagccttcatccgagagagttgagctgttgagaaccatctcagtctcaggagagaggaccggagcctcgaggcccaagagaagagagcttaacgatgaggcgcgcggagccggtcggcgagcaggcggacgcggagcggcgcatgagcgggtacaagggcgtgcggcggcgccggtgggggaagtgggtgtcggagatccgggtgcccggctcgcgggagcgcctgtggctcggctcctacgccacgcccgaggccgccgccgtcgcgcacgacacggccgtctacttcctccgcggcggcggcggcggcccgggcgacgtcgcggcgctcaacttccccgagcgcgcggcggccgcgtacggcgctgggggccgcctgtcgccccggtccgtgcagcgcgtggcgtccgacgccggcatggccgccgacgcgcagctcgtcgcggcgcgggaggacacccgcgcgcatcgcaccggcattggcggtggcgccagcgcgcgcccgcgcgatcgggatgctggtgacgcctgcgcgggccgtgcgcacaacgctagccttcacagtacgggcgccggaagggagcagcctgtctccggggagattagcgtggatgacatggatattttgctgtagtttattgatagcaaaaaaaaaaaaaaaaa

SEQ ID NO: 5464 - protein, 179 aa, Zea mays
  misc_feature: PFam Name: AP2; PFam Description: AP2 domain
  misc_feature: GI Number: 50902248; NR Description: P0408G07.12 [Oryza sativa (japonica cultivar-group)] >gi|20161239|dbj|BAB90166.1| P0408G07.12 [Oryza sativa (japonica cultivar-group)] >gi|21328041|dbj|BAC00626.1| P0434C04.1 [Oryza sativa (japonica
  misc_feature: GI Number: 52075593; NR Description: putative CBF3-like
  misc_feature: GI Number: 16323159; NR Description: AT4g36900/C7A10_460
  misc_feature: GI Number: 21908036; NR Description: DRE binding factor 1
  misc_feature: GI Number: 10177606; NR Description: TINY-like protein [Arabidopsis thaliana] >gi|15240237|ref|NP_201520.1| AP2 domain-containing transcription factor, putative [Arabidopsis
MRRAEPVGEQADAERRMSGYKGVRRRRWGKWVSEIRVPGSRERLWLGSYATPEAAAVAHDTAVYFLRGGGGGPGDVAALNFPERAAAAYGAGGRLSPRSVQRVASDAGMAADAQLVAAREDTRAHRTGIGGGASARPRDRDAGDACAGRAHNASLHSTGAGREQPVSGEISVDDMDILL

SEQ ID NO: 5465 - DNA, 2314 bp, Zea mays
  misc_feature (1)..(2314): Ceres cDNA ID no. 22005813
  misc_feature (1)..(2314): Ceres CLONE  ID no. 1470172
  misc_feature (1)..(2314): Also known as  Ceres CDNA ID no. 24390751
aaccagcccaccacgcgagaactcgtcagatatttatgagcgcagccgcgggttaaccttcccttctcgctgccgtgctcctgctcgtgcgcgcgttcgcaatcgtagcgctggggttgagccgcgagtggataaaccctagccggtggtgtagctgggttggtggctttgatgccggcgacggcccgcttgtccccggaatggagtgaggtgacgaaggctgccatgggctctaactatgccacgattggattataggatagtagctggcagctaccagtttcctagaaccaatttgtggatagcgagaggagtgactgttgttcagtactttcacctcgatcatgggtggtgtctgctcaaggaagagaagccaattggtggatgaaggtgacgctctccagacatccccaaggttctcaaagaccagcagcttaaaatggctgttgcttacactgcctcgcagcagttctgatgtttccgggaagggacagggaaatgaacctgggcggtgcccgtccctcatggagctttgtgtggctagagtttgccaggatatcgacaggtattctacttttgcaatgctgccaagggatctcagccagcagattttcaatgaattagtaaattcaaaccgtcttacagaggcatcacttcaagtttttagggattgtgctctgcaggacattggcttaggggagtaccctggagtaaaggatgcttggatggaagtagtggcatctcaaaagcagtcattgttgtcggttgatatttcttgctctgaagtagctgatagtgggatagatcttcttagagattgctcaagcatgcaaagtttggcatgtaattactgtgatcaaatatccgaaagtggtctgggagtactgtcaggattgtcaaacctatcttctttaagcttcaagcgaagtaatgctgttactgctgaaggaatgagagcctttgcaaatttagttaacttactaaatctcgaccttgaaggttgcctaaagattcatggtggccttattcatttaaaagatctgacaaagctcgagtcattgaatatgagatattgcaattatattgcggattcagatatcaaatatttaacagatctgacaaatttgaaggaccttcaattgtcatgttgtaagatcacagatctgggggtgtcgtatatcagaggcttgcagaagctcactcacttgaacctagagggctgcccagtgactgctgcttgtttggaagctatttcaggattgtcttcattggtattgttgaacttgaaccgttgtggtatatacgatgatggctgtgaaaactttgaaggtcttaaaaggttgaaggttttaaacttggggtttaactatattacagatgcttgtttggtgcatctgaaagaattaatcagtttggagtctttgaacttggattcgtgcaagattggagatgatggtctatcacatctgaaaggtcttgtgctactgcaaagcttggagctttctgatactgaagttggaaacaatggactccagcatctatctggtcttcgtaatctgcaaagtattaatctctcatttactttggtcacggacattggtgtgaagaagatctctgtgttgaattcgctgaagtcagttaaccttgacaatcgccaaattactgatgttggcctggcagcacttataagtctcactaggctgactcatcttgacctttttggagcttgcataactgacaatggcacaaattgcttcagatattttaagaatcttgtttctcttgaagtctgtggtgggttcgttactgatgctggagtgaagaacatcaaggatctgaaggccctgacgttgctgaatctttctcaaaatgctaatctgacagacaaaaccttggagctgatctctggcctgactgctttgatcaacttgaacgtgtcaaactcacgggtgtccaatgctggtctcaaacacctgaatgacctgcacaacctgcgttcactgtctctagattccacccgggtgacggcaaacgagatgaggaagcttcgagcaacagtgctgcataatctgatcagcatgcggccagagtagtacccatttggcacctgctgtaaataatcattaggttcgagcaggttgttctgttggtaagtactgccttcgttctcgaatatttgtcgtccgctagttcatttttgaactagaccgcgataaataaaaaagaacggagggaatatcttgtaagaacctgaattgaaggcaggcatataattatataagttaacaatgtggtctaaaaaaaaaaaaaaaaa

SEQ ID NO: 5466 - protein, 582 aa, Zea mays
  misc_feature: PFam Name: LRR_1; PFam Description: Leucine Rich Repeat
  misc_feature: GI Number: 51979270; NR Description: PREDICTED OJ1004_A05.39 gene product [Oryza sativa (japonica cultivar-group)] >gi|51978852|ref|XP_506866.1| PREDICTED OJ1004_A05.39 gene product [Oryza sativa (japonica cultivar-group)] [Oryza sativa
  misc_feature: GI Number: 59802533; NR Description: putative regulatory
  misc_feature: GI Number: 9366571; NR Description: hypothetical leucine-rich
  misc_feature: GI Number: 9366582; NR Description: hypothetical leucine-rich
  misc_feature: GI Number: 17546519; NR Description: PROBABLE GALA PROTEIN
MGGVCSRKRSQLVDEGDALQTSPRFSKTSSLKWLLLTLPRSSSDVSGKGQGNEPGRCPSLMELCVARVCQDIDRYSTFAMLPRDLSQQIFNELVNSNRLTEASLQVFRDCALQDIGLGEYPGVKDAWMEVVASQKQSLLSVDISCSEVADSGIDLLRDCSSMQSLACNYCDQISESGLGVLSGLSNLSSLSFKRSNAVTAEGMRAFANLVNLLNLDLEGCLKIHGGLIHLKDLTKLESLNMRYCNYIADSDIKYLTDLTNLKDLQLSCCKITDLGVSYIRGLQKLTHLNLEGCPVTAACLEAISGLSSLVLLNLNRCGIYDDGCENFEGLKRLKVLNLGFNYITDACLVHLKELISLESLNLDSCKIGDDGLSHLKGLVLLQSLELSDTEVGNNGLQHLSGLRNLQSINLSFTLVTDIGVKKISVLNSLKSVNLDNRQITDVGLAALISLTRLTHLDLFGACITDNGTNCFRYFKNLVSLEVCGGFVTDAGVKNIKDLKALTLLNLSQNANLTDKTLELISGLTALINLNVSNSRVSNAGLKHLNDLHNLRSLSLDSTRVTANEMRKLRATVLHNLISMRPE

SEQ ID NO: 5467 - DNA, 1733 bp, Zea mays
  misc_feature (1)..(1733): Ceres cDNA ID no. 22005814
  misc_feature (1)..(1733): Ceres CLONE  ID no. 1471606
  misc_feature (1)..(1733): Also known as  Ceres CDNA ID no. 24390777
aagggagatggggagagcgtgcgtgagctccaatggcgactgctcgtgtcgggaggcttagtaggacgactacgagcaggcgggcgcgtgcggggtgctgcgtgcatggaggccaagccgggggaagccagtgttgggcatgcgcctgcgcctatggcggcggcagcaccggttatggcggcgccaccactagaggagactgtgagcttccagcagccgctgccggcgccggccgcggcggcggagaggggcagctcgagcgccgtcctggtgccgcctcttgctacggcggcgggaggcggcgcgatggcgctcgtgccggtgctgatgaaggtgccgaagaagcgagggaggccgcgcaagtacgggccggacgggagcctgatccgcccgctcaacgccacgccgatctcggcgtccgcgcccttgccggccgccgtggcgcctgggcactacacgccggcctccgcggtgggcgccgccatgaagcgtggcaggggacggccccttgacttcgccgccgccgccgccaagcagcaccagcagcatcaccaccagctctaccagcatcagcagcagcagttcggcttccacttcgactccattggtgatatgggggcatgttcagctggtgcaaatttcactccacacataattacagtcgctcctggtgaggatgtgatgacgaaggtcatatcgttttcccaacaaggaccacgagctatctgtgttctctctgcaaatggtgtaatatccaccgttacactctgtcagcctgattcctctggtggcacgttaacttacgagggacgctttgagttgctgtccctgtctgggtccttcatgccaaccgaaaacggcgggacacgaagtcgatcaggtgggatgagcgtgtctctcgcgagtccagacggtcgtgttgtcggtggcggggttgccggcctgctggtggcagcgagtcctgttcagattgtggttgggagcttcctgccaagctaccagatggagcagaagaacaagaagccacgggtggacgcggcacctgctgccgccgtcccgcagacgcctcccgcagtcccgatctcgagcacagacacccgcagcagcgagcaagggcagcagagctccgcgtcccagagaggggtgaacatgacggtcccgggaggaacctacggcgcggaccagagctgggtgttgtcccctgctccgcagcagccgatggccgaggtgtccaggacgccgtcgtctggggacctgaagatgaccacgtccggatcatgagcactctgaaacccagccggagctagccacccacgcactgactgggagccaaggtccccgctggaagatggaaggatggggtcatggattggttcatttgttcctgactcttgctgcaaatctcgcactagggcggtctagtctagttgttgctgtatgatgagcgcgccaggcaggaggaggggagtctaacaactgcacttgctgccattgtcggggagtgcgtgtgtgtagtgcagcagctattaacaccacagtttgagtgtgctagcggcgtgtgtttttatttagggctaccttgtcgattaaattcttgtgtcgggattattacctttaccttacgtgctggtttagtttggcaccctgtatctgtatctgtattggatcacgcccacccttggcttaaatcagcattagaaaaaaaaaaaaaaaaaaaaaaaaaaaaaaaaaaa

SEQ ID NO: 5468 - protein, 391 aa, Zea mays
  misc_feature: GI Number: 50940551; NR Description: putative AT-hook protein 1 [Oryza sativa (japonica cultivar-group)] >gi|42407899|dbj|BAD09039.1| putative AT-hook protein 1 [Oryza sativa (japonica cultivar-group)] >gi|50725642|dbj|BAD33109.1|
  misc_feature: GI Number: 50904929; NR Description: putative AT-hook DNA-binding protein [Oryza sativa (japonica cultivar-group)] >gi|41053039|dbj|BAD07970.1| putative AT-hook DNA-binding protein
  misc_feature: GI Number: 15241763; NR Description: AT hook motif-containing
  misc_feature: GI Number: 50947571; NR Description: putative AT-hook DNA-binding protein [Oryza sativa (japonica cultivar-group)] >gi|42408801|dbj|BAD10062.1| putative AT-hook DNA-binding protein
  misc_feature: GI Number: 23506149; NR Description: At4g12080/F16J13_150 [Arabidopsis thaliana] >gi|17979485|gb|AAL50079.1| AT4g12080/F16J13_150 [Arabidopsis thaliana] >gi|22328578|ref|NP_192945.2| DNA-binding family protein
MEAKPGEASVGHAPAPMAAAAPVMAAPPLEETVSFQQPLPAPAAAAERGSSSAVLVPPLATAAGGGAMALVPVLMKVPKKRGRPRKYGPDGSLIRPLNATPISASAPLPAAVAPGHYTPASAVGAAMKRGRGRPLDFAAAAAKQHQQHHHQLYQHQQQQFGFHFDSIGDMGACSAGANFTPHIITVAPGEDVMTKVISFSQQGPRAICVLSANGVISTVTLCQPDSSGGTLTYEGRFELLSLSGSFMPTENGGTRSRSGGMSVSLASPDGRVVGGGVAGLLVAASPVQIVVGSFLPSYQMEQKNKKPRVDAAPAAAVPQTPPAVPISSTDTRSSEQGQQSSASQRGVNMTVPGGTYGADQSWVLSPAPQQPMAEVSRTPSSGDLKMTTSGS

SEQ ID NO: 5469 - DNA, 985 bp, Zea mays
  misc_feature (1)..(985): Ceres cDNA ID no. 22005816
  misc_feature (1)..(985): Ceres CLONE  ID no. 1473908
  misc_feature (1)..(985): Also known as  Ceres CDNA ID no. 22005816
gctcttgccatggaggtgccgctctccccaccgcgtgcctcacgccggcctcctctgctgcagctccactcccgtcgacctcggcctccgctccaaatccgccaccgctccgagccgccgcgcgcggccactccttgcccgcaggaacctgggacagccggagcgacgaggagaccgcggcggagcccaagatcatcacggtcgggcggccggggaagagcgggcggcggcgcaacaggaagcagcagcagcagcagcagcagacggcggcgaaggaagaagaagaagaagaagaggaggaagatgaggacgaggaggaggagcgtgacgcgacgatcccggaggtggtgacgaaccggatgatgcggcgggtgggcgcgtcggtggggcttccgctggcgctgggcgtggggttgttcccggtgttctactacctgaaggcggtggtgaaggtggacgtgccgacgtggatccccttcgacgtgtcgttcgtcttcttcggcgcggcgctggccggggtgagctacggcatcgtgtccgcgagctgggaccccgcccgggagggctccctgctcggctggaacgaggcgcgccgcaactggcccgtcttctgggactcgctccggggacgctccccacctcgccgggggctaggagtttgtctcggaaacttgggctcttgcattggtggtggtgtgtaaatccacgtcgatcgatcggtcgcttgtgttggggttggggacggggggttcaatgagaatttgcatctctggtttggttcagtaagagggatggaatggattcacggcagtgctcaatccattccatctgtgcgtgaaatcatcttattcaggaaccatctctgtcactgatttcacgcaagatcttgttcggttatttatagtacacgtacacatgaattagatgatattaaaaaattaataaaagtttaatcttccaaaaaaaaaaaaaaaaacgagacgct

SEQ ID NO: 5470 - protein, 985 aa, Zea mays
GCTCTTGCCATGGAGGTGCCGCTCTCCCCACCGCGTGCCTCACGCCGGCCTCCTCTGCTGCAGCTCCACTCCCGTCGACCTCGGCCTCCGCTCCAAATCCGCCACCGCTCCGAGCCGCCGCGCGCGGCCACTCCTTGCCCGCAGGAACCTGGGACAGCCGGAGCGACGAGGAGACCGCGGCGGAGCCCAAGATCATCACGGTCGGGCGGCCGGGGAAGAGCGGGCGGCGGCGCAACAGGAAGCAGCAGCAGCAGCAGCAGCAGACGGCGGCGAAGGAAGAAGAAGAAGAAGAAGAGGAGGAAGATGAGGACGAGGAGGAGGAGCGTGACGCGACGATCCCGGAGGTGGTGACGAACCGGATGATGCGGCGGGTGGGCGCGTCGGTGGGGCTTCCGCTGGCGCTGGGCGTGGGGTTGTTCCCGGTGTTCTACTACCTGAAGGCGGTGGTGAAGGTGGACGTGCCGACGTGGATCCCCTTCGACGTGTCGTTCGTCTTCTTCGGCGCGGCGCTGGCCGGGGTGAGCTACGGCATCGTGTCCGCGAGCTGGGACCCCGCCCGGGAGGGCTCCCTGCTCGGCTGGAACGAGGCGCGCCGCAACTGGCCCGTCTTCTGGGACTCGCTCCGGGGACGCTCCCCACCTCGCCGGGGGCTAGGAGTTTGTCTCGGAAACTTGGGCTCTTGCATTGGTGGTGGTGTGTAAATCCACGTCGATCGATCGGTCGCTTGTGTTGGGGTTGGGGACGGGGGGTTCAATGAGAATTTGCATCTCTGGTTTGGTTCAGTAAGAGGGATGGAATGGATTCACGGCAGTGCTCAATCCATTCCATCTGTGCGTGAAATCATCTTATTCAGGAACCATCTCTGTCACTGATTTCACGCAAGATCTTGTTCGGTTATTTATAGTACACGTACACATGAATTAGATGATATTAAAAAATTAATAAAAGTTTAATCTTCCAAAAAAAAAAAAAAAAACGAGACGCT

SEQ ID NO: 5471 - DNA, 2325 bp, Zea mays
  misc_feature (1)..(2325): Ceres cDNA ID no. 22005817
  misc_feature (1)..(2325): Ceres CLONE  ID no. 1476543
  misc_feature (1)..(2325): Also known as  Ceres CDNA ID no. 24364476
aaagctagccgggcatgaagagaggagagaccgcggggtgggaactgcaagcgtcgtgcgatcaggagagaggggcgtcagccgaaggtagacggcgggcgatggaggcgagctcggccgcgtcgccggacctgtcgctgcacatcagcctgcctagcagcgcggcggggtccggcccgtccggcaggcgcgccgccgtggggggaggaacgggaggaggaggaggcgccgggggagacccgtggcggaggctgaacgggtccacagcgtccacggagctgtccctgtcgccgccggtcgagcaggagcacgcggacgcgctgccgtggcgacaccggccgtcggcggcggccgcgtcctccgcggccaccacgtcggcgggcgccacgctgatgcccgccatgccgatgcttcagccgctggacggcgggggcgggctaggcgccggcgccggcgcaggagggggagcgtcggtggcgctgccaatccgagggatacctatctacaacggcccggggggcttcccgttccttccgccggcctccggggccgacggcgcccccctccaccaccaccagcagcagcagaagctcgggttctacggctcgtaccacccgagcacgtggccctcgtcgctcggctccacgtcgccgtcgccgtcgccgctcgcgccgggcacgccgccgtccccgctgctggacccagcgtcggcggcgttcctgtccccggccgcgcatcaccaccaccggatgctgtcggcatcgggccggctcaacggcatgctcaccgacaccctccgcggctacggcgctggcggcgtcggcggactgggcggcatcgtcggcgggcaccaccaccaccaccaccacctccacggcgcgcagccgttcggcctgggctcccggttcatgcccaagctccccgccaagcgcagcatgcgcgcgccgcgcatgcggtggacgagcacgctccacgcccgcttcgtccacgccgtcgagctcctcggaggccacgagagggctacgcccaagtcggtgctggagctcatggacgtgaaggatctgaccctagcccacgtcaagagccatctccagatgtatcggaccgtgaagagcactgacaagcctgcggcgtcatcaggggcgaacgacggcggctccggcgacgaggacttcgccggcggtggccaggctggctccggcggcgagaacatgtgcgcgaggccgttcggggagcaccggtccacctccgagggtgcggcgagctcggtgggcggcggcggcgggggcgacatggaccagtcttcggcaggcaacggcagcaccaggtggagcaactcgtcaagggacccatggctgtcgtcgaattcatgcaacatggatgctcatcgcttggcagcgttgtcttctccgattgagaacggggagccttgccgatcgagcagctcgcaggtgtcgaaccaggagctgatgagcagcccgagcctggagttcacgcttgggaggccggactggcagggcacggatcatgactagcagtagcaatagctaagctactagctgctagccatgcgtcgaccgtacgtggagctctagctagctagaaggctaacttcttcattgaggccgggtggttatagtagcagcactactactgatatcaggcggtgcgcgcgtgtgcatgcctgatgatcccccaagcaactcgtagacgacgacgacgacgacaggttttttcgcctgcgaagtcgaacagatcaatcaacaagtacagcagcagcagcaaccgcgcgcgtctccatcgatgggtgtggagatcatggtgagtacgtacgtgccgacggacggagcaccggcctggaagaagggattttaaagacttactgggtcactctctctatttcttctctgtcagagagagggagggagagttgagtgggctgcctttgggtgagtggtttgttagattggccatgccatgttcctgatttccttttctttcttgcttctctctctttttgtttccttgtgccatgtcgagcgggcgcgagattgtgtcagcgcagccggcggtgcagcagggggtatgcatgatgggagtcgtcgtagctggctggctagctgatgatggcgagagagaggcgtaaagctagccttgtgtggtggtgtgggagtgagtgagtgagtcgtgtgcgttcgtccaatgcatgtttggtccgtgtggtgtgtgaagctagctatacctagcgtatcattagcacatgcaaagctggaaaggagagaaaagaaagaaaagggaatgagttctcaaaaaaaaaaaaaaaaa

SEQ ID NO: 5472 - protein, 2325 aa, Zea mays
  misc_feature: PFam Name: Myb_DNA-binding; PFam Description: Myb-like
  misc_feature: PFam Name: PHO4; PFam Description: Phosphate transporter family
  misc_feature: PFam Name: FH2; PFam Description: Formin Homology 2 Domain
  misc_feature: GI Number: 50945913; NR Description: myb family transcription factor-like [Oryza sativa (japonica cultivar-group)] >gi|29837235|dbj|BAC75613.1| myb family transcription factor-like
  misc_feature: GI Number: 15723591; NR Description: GARP-like putative transcription factor KANADI1 [Arabidopsis thaliana] >gi|14345995|gb|AAK59989.1| KANADI protein [Arabidopsis thaliana] >gi|18418011|ref|NP_568334.1| myb family transcription factor
  misc_feature: GI Number: 34905232; NR Description: myb family transcription factor-like protein [Oryza sativa (japonica cultivar-group)] >gi|29467563|dbj|BAC66733.1| myb family transcription factor-like protein [Oryza sativa (japonica cultivar-group)]
  misc_feature: GI Number: 15723597; NR Description: GARP-like putative transcription factor KANADI3 [Arabidopsis thaliana] >gi|18414945|ref|NP_567535.1| myb family transcription factor
  misc_feature: GI Number: 50911755; NR Description: myb family transcription factor-like [Oryza sativa (japonica cultivar-group)] >gi|41053204|dbj|BAD08167.1| myb family transcription factor-like [Oryza sativa (japonica cultivar-group)] [Oryza sativa (japonica
AAAGCTAGCCGGGCATGAAGAGAGGAGAGACCGCGGGGTGGGAACTGCAAGCGTCGTGCGATCAGGAGAGAGGGGCGTCAGCCGAAGGTAGACGGCGGGCGATGGAGGCGAGCTCGGCCGCGTCGCCGGACCTGTCGCTGCACATCAGCCTGCCTAGCAGCGCGGCGGGGTCCGGCCCGTCCGGCAGGCGCGCCGCCGTGGGGGGAGGAACGGGAGGAGGAGGAGGCGCCGGGGGAGACCCGTGGCGGAGGCTGAACGGGTCCACAGCGTCCACGGAGCTGTCCCTGTCGCCGCCGGTCGAGCAGGAGCACGCGGACGCGCTGCCGTGGCGACACCGGCCGTCGGCGGCGGCCGCGTCCTCCGCGGCCACCACGTCGGCGGGCGCCACGCTGATGCCCGCCATGCCGATGCTTCAGCCGCTGGACGGCGGGGGCGGGCTAGGCGCCGGCGCCGGCGCAGGAGGGGGAGCGTCGGTGGCGCTGCCAATCCGAGGGATACCTATCTACAACGGCCCGGGGGGCTTCCCGTTCCTTCCGCCGGCCTCCGGGGCCGACGGCGCCCCCCTCCACCACCACCAGCAGCAGCAGAAGCTCGGGTTCTACGGCTCGTACCACCCGAGCACGTGGCCCTCGTCGCTCGGCTCCACGTCGCCGTCGCCGTCGCCGCTCGCGCCGGGCACGCCGCCGTCCCCGCTGCTGGACCCAGCGTCGGCGGCGTTCCTGTCCCCGGCCGCGCATCACCACCACCGGATGCTGTCGGCATCGGGCCGGCTCAACGGCATGCTCACCGACACCCTCCGCGGCTACGGCGCTGGCGGCGTCGGCGGACTGGGCGGCATCGTCGGCGGGCACCACCACCACCACCACCACCTCCACGGCGCGCAGCCGTTCGGCCTGGGCTCCCGGTTCATGCCCAAGCTCCCCGCCAAGCGCAGCATGCGCGCGCCGCGCATGCGGTGGACGAGCACGCTCCACGCCCGCTTCGTCCACGCCGTCGAGCTCCTCGGAGGCCACGAGAGGGCTACGCCCAAGTCGGTGCTGGAGCTCATGGACGTGAAGGATCTGACCCTAGCCCACGTCAAGAGCCATCTCCAGATGTATCGGACCGTGAAGAGCACTGACAAGCCTGCGGCGTCATCAGGGGCGAACGACGGCGGCTCCGGCGACGAGGACTTCGCCGGCGGTGGCCAGGCTGGCTCCGGCGGCGAGAACATGTGCGCGAGGCCGTTCGGGGAGCACCGGTCCACCTCCGAGGGTGCGGCGAGCTCGGTGGGCGGCGGCGGCGGGGGCGACATGGACCAGTCTTCGGCAGGCAACGGCAGCACCAGGTGGAGCAACTCGTCAAGGGACCCATGGCTGTCGTCGAATTCATGCAACATGGATGCTCATCGCTTGGCAGCGTTGTCTTCTCCGATTGAGAACGGGGAGCCTTGCCGATCGAGCAGCTCGCAGGTGTCGAACCAGGAGCTGATGAGCAGCCCGAGCCTGGAGTTCACGCTTGGGAGGCCGGACTGGCAGGGCACGGATCATGACTAGCAGTAGCAATAGCTAAGCTACTAGCTGCTAGCCATGCGTCGACCGTACGTGGAGCTCTAGCTAGCTAGAAGGCTAACTTCTTCATTGAGGCCGGGTGGTTATAGTAGCAGCACTACTACTGATATCAGGCGGTGCGCGCGTGTGCATGCCTGATGATCCCCCAAGCAACTCGTAGACGACGACGACGACGACAGGTTTTTTCGCCTGCGAAGTCGAACAGATCAATCAACAAGTACAGCAGCAGCAGCAACCGCGCGCGTCTCCATCGATGGGTGTGGAGATCATGGTGAGTACGTACGTGCCGACGGACGGAGCACCGGCCTGGAAGAAGGGATTTTAAAGACTTACTGGGTCACTCTCTCTATTTCTTCTCTGTCAGAGAGAGGGAGGGAGAGTTGAGTGGGCTGCCTTTGGGTGAGTGGTTTGTTAGATTGGCCATGCCATGTTCCTGATTTCCTTTTCTTTCTTGCTTCTCTCTCTTTTTGTTTCCTTGTGCCATGTCGAGCGGGCGCGAGATTGTGTCAGCGCAGCCGGCGGTGCAGCAGGGGGTATGCATGATGGGAGTCGTCGTAGCTGGCTGGCTAGCTGATGATGGCGAGAGAGAGGCGTAAAGCTAGCCTTGTGTGGTGGTGTGGGAGTGAGTGAGTGAGTCGTGTGCGTTCGTCCAATGCATGTTTGGTCCGTGTGGTGTGTGAAGCTAGCTATACCTAGCGTATCATTAGCACATGCAAAGCTGGAAAGGAGAGAAAAGAAAGAAAAGGGAATGAGTTCTCAAAAAAAAAAAAAAAAA

SEQ ID NO: 5473 - DNA, 868 bp, Zea mays
  misc_feature (1)..(868): Ceres cDNA ID no. 22005819
  misc_feature (1)..(868): Ceres CLONE  ID no. 1491731
  misc_feature (1)..(868): Also known as  Ceres CDNA ID no. 23843446
agtagctcctccagtccttctgctacacagaaacgccatcgcctccgcccaaaaaacagcctccacacacgacctaaatcttttcctgcccacgggcgactcccaaacccaacagcagcaagaaagccaaggaaaacactcatttccttcttccttccttctctaccatatagccaagaaccgaaggtagcttgcgacttggcaagctacaagttgggcgattcaagcagcaggatggtggcgccggtggtgatcgcgtcggcggggctgggcatgctggccggcgtggcgatggccaaccggtcccttggggacgggctcccggcggcctacaggtgtgacgcgcgcccgcgctgcgccacgtgcggcggctccggccgagtcgagtgcttgtgcaaccgctggtccgatggcgactcaggctgccggacctgcgcggggtcggggaggatgccctgccgcagctgcggcggctccggcaccggcaggccgctcccggcgcggctcaccgtccagcaccagaagccgccgccgccggccggctacaactgatggaataattaggtatccatatccgtggattgtataattcacgcgggaatatatatatggtgcaacccatccaggaaatcagttcaactgcgagatgattatgcatgtacatgcctcttcttcaagaccggttgtaatatattgtgctgaggacactcggtgtcgctgttgttcagttaatatgcaaattgcacagcacaagaaaaaagaagaaaaactgtgttgaaatggtttttttctttagagatctaaggaaaatatatgattgagaagggagagctgtccgtgattctaaacacaaaaaaaaaaaaaaaaa

SEQ ID NO: 5474 - protein, 105 aa, Zea mays
  misc_feature: GI Number: 50908809; NR Description: putative drought-induced protein [Oryza sativa (japonica cultivar-group)] >gi|48716138|dbj|BAD23178.1| putative drought-induced protein
  misc_feature: GI Number: 35187445; NR Description: fiber protein Fb25
  misc_feature: GI Number: 37788355; NR Description: drought-induced protein
MVAPVVIASAGLGMLAGVAMANRSLGDGLPAAYRCDARPRCATCGGSGRVECLCNRWSDGDSGCRTCAGSGRMPCRSCGGSGTGRPLPARLTVQHQKPPPPAGYN

SEQ ID NO: 5475 - DNA, 965 bp, Zea mays
  misc_feature (1)..(965): Ceres cDNA ID no. 22005820
  misc_feature (1)..(965): Ceres CLONE  ID no. 1494158
  misc_feature (1)..(965): Also known as  Ceres CDNA ID no. 23837251
atacggtgaacaggttggtatatcttaaaacgggatcatacccaagatgggatattgcattggtgtgacaaaaggaatcatgaaaattcttgcatggcatatctgaatttaatgggacgactgatgttaagaaaataattatgaatggtcagagtcgtcgcggttcccgggatctcattggaactctgtggtgggactcacgtcagtaatactgctgagattcgtggtttcaagataatttcagaacaaggaatagcttctgggatcagaaggatagaagcagttgcaggtgatgcttttgttgactatgtgtgtgctcgggacaactacatgcggcgcttatgcttatcccttaaggttaaggctgaagatgtgaacagtagagtagaaacaattcttgaagagctaagagcaaccagaaacgaagcatcatctctacgcagcaaaattgcagtgctaaaagcagcttctcttgcaagtagagctacaactgtggagccccagaatgtcaggattgtggtcgagaacatgggtgatgtagacgcagatgggctgaaaagcgctgcggagcatctcatagacaccctcaaagaccctgctgcggtgattttaggatcaagcccaggggatggtaaagtcagcctggttgctgccttcagccctgcaatcgtcgaaatggggctgcaggccgggaagttcgtgagtggcatagccaaactctgcggcggaggcggtggaggcaagcccaatttcgcccaagctggggggcggaagccggagaacttgcccgacgcccttgagaaagcccgagctgaaattgtggcacgggtatcaggttcgagctgattctccgctgcctcacacctgatactggaagtatagggataggattcatatgaaatgtatatgtaattgtcattggcattctaagcgaaaacacttgtatttcaaaaaaaaaaaaaaaa

SEQ ID NO: 5476 - protein, 233 aa, Zea mays
  misc_feature: PFam Name: DHHA1; PFam Description: DHHA1 domain
  misc_feature: PFam Name: tRNA-synt_2c; PFam Description: tRNA synthetases
  misc_feature: PFam Name: tRNA_SAD; PFam Description: Threonyl and Alanyl
  misc_feature: GI Number: 10177227; NR Description: alanyl-tRNA synthetase
  misc_feature: GI Number: 30688660; NR Description: aminoacyl-tRNA
  misc_feature: GI Number: 48892171; NR Description: COG0013: Alanyl-tRNA
  misc_feature: GI Number: 53765229; NR Description: COG0013: Alanyl-tRNA
  misc_feature: GI Number: 17229910; NR Description: alanyl-tRNA synthetase [Nostoc sp. PCC 7120] >gi|20532251|sp|Q8YUD4|SYA_ANASP Alanyl-tRNA synthetase (Alanine--tRNA ligase) (AlaRS) >gi|25293093|pir||AC2108 alanyl-tRNA synthetase [imported] -
MVRVVAVPGISLELCGGTHVSNTAEIRGFKIISEQGIASGIRRIEAVAGDAFVDYVCARDNYMRRLCLSLKVKAEDVNSRVETILEELRATRNEASSLRSKIAVLKAASLASRATTVEPQNVRIVVENMGDVDADGLKSAAEHLIDTLKDPAAVILGSSPGDGKVSLVAAFSPAIVEMGLQAGKFVSGIAKLCGGGGGGKPNFAQAGGRKPENLPDALEKARAEIVARVSGSS

SEQ ID NO: 5477 - DNA, 1047 bp, Zea mays
  misc_feature (1)..(1047): Ceres cDNA ID no. 22005821
  misc_feature (1)..(1047): Ceres CLONE  ID no. 1496062
  misc_feature (1)..(1047): Also known as  Ceres CDNA ID no. 24390991
aagacgtcaagatgcctttcgtcaagctccagaagaactctgcctacttctccaggttccaggtcaaggccaggaggagaagggagggaaagaccgactactacgccaggaagcgattggtcgcccaggccaagaacaagtacaactcgcccaagtacaggttggttgtcaggttcaccaacaagcagatcatcgtccagatcgtctacgccaagctccagggagactttgtcttctgcgccgcttcctcgtcggagcttccccgatacggagtcaagcacggtcttaccaactggacctctgcttacgccaccggtctcctctgtgctcgtcgtgccctcaagaagctcggcttggacgagaagtacgagggtatcaccgagcccgatggtgagatgaccatcaccgaggctttggagggtgacgacgagcccaggcctttcaaggtcttcctcgatgtcggtctcaagaggaccaccaccggtaaccgaatcttcggtgccttgaagggtgcttcggacggtggtctctacgttccccacaacgagaagaggttccccggttacgacatcgagtccaaggagttggacgccgagaccttgcaaaagtacatcgtcggtggacacatcgccgagtacatggagtccctcgaggaggaagacgacgagaggttcaagaagcagttctcgacctacctcgccgatggtgtcggttccgaggacatcgaggaggtcttcaccgccgcctacgccgccatccgagaggaccccgagttcaagcccaccgagaaggacaccgccaagtggaccgccgagtccaagaagtacaagtcccccaagctcacctacgagcagaggcaggccagggtcgaggagaagatcgccgcctacaaggccggtcaggcttccgacgacgaggagtagattcgcgctcttcgcgaaacgatgccttgacgaacgaatccactccacgatgctttttgtactccgttcatgacgctcgctatatcatgcgcatgttcgggaaaagaaaaaaaaaaaaaaaaaa

SEQ ID NO: 5478 - protein, 303 aa, Zea mays
  misc_feature: PFam Name: Ribosomal_L18p; PFam Description: Ribosomal
  misc_feature: PFam Name: Pyr_redox_2; PFam Description: Pyridine
  misc_feature: GI Number: 19113191; NR Description: 60s ribosomal protein l5.; 60s ribosomal protein l5-b. [Schizosaccharomyces pombe] >gi|6094082|sp|O74306|RL5B_SCHPO 60S ribosomal protein L5-B >gi|7490045|pir||T39325 60s ribosomal protein l5 - fission yeast
  misc_feature: GI Number: 19115092; NR Description: 60s ribosomal protein L5 [Schizosaccharomyces pombe] >gi|3123272|sp|P52822|RL5A_SCHPO 60S ribosomal protein L5-A >gi|7490044|pir||T38758 60s ribosomal protein L5 - fission yeast (Schizosaccharomyces pombe)
  misc_feature: GI Number: 19577350; NR Description: probable 60S ribosomal protein l5 [Aspergillus fumigatus] >gi|42820691|emb|CAF32004.1| 60S
  misc_feature: GI Number: 32406116; NR Description: 60S RIBOSOMAL PROTEIN L5 (CPR4) [Neurospora crassa] >gi|6094087|sp|O59953|RL5_NEUCR 60S ribosomal protein L5 (CPR4) >gi|3003044|gb|AAC09000.1| putative 5S rRNA binding ribosomal protein [Neurospora crassa]
  misc_feature: GI Number: 42544828; NR Description: RL5_NEUCR 60S ribosomal protein L5 (CPR4) [Gibberella zeae PH-1] >gi|46136989|ref|XP_390186.1| RL5_NEUCR 60S ribosomal protein L5
MPFVKLQKNSAYFSRFQVKARRRREGKTDYYARKRLVAQAKNKYNSPKYRLVVRFTNKQIIVQIVYAKLQGDFVFCAASSSELPRYGVKHGLTNWTSAYATGLLCARRALKKLGLDEKYEGITEPDGEMTITEALEGDDEPRPFKVFLDVGLKRTTTGNRIFGALKGASDGGLYVPHNEKRFPGYDIESKELDAETLQKYIVGGHIAEYMESLEEEDDERFKKQFSTYLADGVGSEDIEEVFTAAYAAIREDPEFKPTEKDTAKWTAESKKYKSPKLTYEQRQARVEEKIAAYKAGQASDDEE

SEQ ID NO: 5479 - DNA, 682 bp, Zea mays
  misc_feature (1)..(682): Ceres cDNA ID no. 22005825
  misc_feature (1)..(682): Ceres CLONE  ID no. 1515957
  misc_feature (1)..(682): Also known as  Ceres CDNA ID no. 24390696
aaaaccataagagcttctgaagagcgaaatacttcagtctagacactagatacagtaagccttagcgcaccaacagaggatacttcaaatatgtctgcctcgcggagctcctctcccaactccatgtcacagtggagccagaaagagaacaagatgtttgaagaggcactcgcctactatggcgagggcacacccaaccggtgggacaaggtgtccagcgccatgggaggcatcaagtctgccgaggaggtgcgctgccactatgaaaatcttgattacgacgtcaagatgattgagtcaggcaatgtgccgtaccccaagtacaagacacagggattctggacccgaggttaaaaaaatgttggaggctcaaagaggcagaaaacaaagctctacggatccaagaaggaaccaaaggaaatccagctctggttggagaataaaatgatgaaccagtgtgtatatgtcaatatgtgtatagtatagtttatgatcaagtttatgtctgtctacctgtggttgtaggatcctagtgtacataagattgataaccacatgtattcattgtccccttgaactaaagttatggagggtgtaaagtctaaaagtcatgtatttatgcaaactaaaaaaacaatgcctcgtagcaaaaaaaaaaaaaaaaaaaaaaaaaaaaaaaaaa

SEQ ID NO: 5480 - protein, 87 aa, Zea mays
  misc_feature: PFam Name: Myb_DNA-binding; PFam Description: Myb-like
  misc_feature: PFam Name: Arv1; PFam Description: Arv1-like family
  misc_feature: PFam Name: Ras; PFam Description: Ras family
  misc_feature: PFam Name: BLVR; PFam Description: Bovine leukaemia virus
  misc_feature: PFam Name: Nsp1_C; PFam Description: Nsp1-like C-terminal region
  misc_feature: GI Number: 34912082; NR Description: P0671D01.20 [Oryza sativa (japonica cultivar-group)] >gi|20521226|dbj|BAB91743.1|
  misc_feature: GI Number: 32416700; NR Description: predicted protein [Neurospora crassa] >gi|28925626|gb|EAA34645.1| predicted protein
  misc_feature: GI Number: 38566494; NR Description: At4g36570 [Arabidopsis thaliana] >gi|40823588|gb|AAR92291.1| At4g36570 [Arabidopsis
  misc_feature: GI Number: 33518695; NR Description: polylysine protein
  misc_feature: GI Number: 34189885; NR Description: TAO1 protein [Homo sapiens]
MSASRSSSPNSMSQWSQKENKMFEEALAYYGEGTPNRWDKVSSAMGGIKSAEEVRCHYENLDYDVKMIESGNVPYPKYKTQGFWTRG

SEQ ID NO: 5481 - DNA, 856 bp, Zea mays
  misc_feature (1)..(856): Ceres cDNA ID no. 22005826
  misc_feature (1)..(856): Ceres CLONE  ID no. 1518245
  misc_feature (1)..(856): Also known as  Ceres CDNA ID no. 24360714
aacccagaaatccagaaccccagttcggttcccccatatctagcggtcgacgctccaccatccttctccaggactgccaagccaaccagcaagtcgatcctcttcttcggctcttcttctgctgacatcgctcgctcggtttcttgttggatcgtcgagcccggccggagagcagaggcagctaactgacagcagcgcgcgcgcagaggagaagcgaaatggcggcggcgacgatgggcgcggtgcgggtgctgtgcggcgcggagaaggagcgggtggtgggcgcgcacaaggcgcccggggcgtgcccgcgctgcggcggggccgtggtggccgtcgacgtggagagcgagcggcgcgtcctcggcctgccgctgtgcctcaagagcaagcgcaagtactcctgcacccgctgcctccgccgactcgtcaccctctgcggctgaaggatcggacctgagtgcagacaaggctgggctcttgcccaggctcctaatccctgctgcttcaacaatgtctctctgcttcaacaaactagctaatctgtgcttctagctagctagttgcctgtaataatgtaaatgatagtacgtaattgtcagggcccgtgtatggcgaccggcaccggcggtcagcagaggcggcgagccggcaaccatgcgaaaaagaggccgctcgctgcggccgtcaccatctttgcttggaaatagtaaaactattcatagtactgtagtaaagagagtgtaactttctgttggtgctcggccgatgtggcgcatttgggatgttaatattaatgaatgaatgaaatgcgcatgctgcactcgacaaaaaaaaaaaaaaaaaaaaaaaaaaa

SEQ ID NO: 5482 - protein, 856 aa, Zea mays
AACCCAGAAATCCAGAACCCCAGTTCGGTTCCCCCATATCTAGCGGTCGACGCTCCACCATCCTTCTCCAGGACTGCCAAGCCAACCAGCAAGTCGATCCTCTTCTTCGGCTCTTCTTCTGCTGACATCGCTCGCTCGGTTTCTTGTTGGATCGTCGAGCCCGGCCGGAGAGCAGAGGCAGCTAACTGACAGCAGCGCGCGCGCAGAGGAGAAGCGAAATGGCGGCGGCGACGATGGGCGCGGTGCGGGTGCTGTGCGGCGCGGAGAAGGAGCGGGTGGTGGGCGCGCACAAGGCGCCCGGGGCGTGCCCGCGCTGCGGCGGGGCCGTGGTGGCCGTCGACGTGGAGAGCGAGCGGCGCGTCCTCGGCCTGCCGCTGTGCCTCAAGAGCAAGCGCAAGTACTCCTGCACCCGCTGCCTCCGCCGACTCGTCACCCTCTGCGGCTGAAGGATCGGACCTGAGTGCAGACAAGGCTGGGCTCTTGCCCAGGCTCCTAATCCCTGCTGCTTCAACAATGTCTCTCTGCTTCAACAAACTAGCTAATCTGTGCTTCTAGCTAGCTAGTTGCCTGTAATAATGTAAATGATAGTACGTAATTGTCAGGGCCCGTGTATGGCGACCGGCACCGGCGGTCAGCAGAGGCGGCGAGCCGGCAACCATGCGAAAAAGAGGCCGCTCGCTGCGGCCGTCACCATCTTTGCTTGGAAATAGTAAAACTATTCATAGTACTGTAGTAAAGAGAGTGTAACTTTCTGTTGGTGCTCGGCCGATGTGGCGCATTTGGGATGTTAATATTAATGAATGAATGAAATGCGCATGCTGCACTCGACAAAAAAAAAAAAAAAAAAAAAAAAAAA

SEQ ID NO: 5483 - DNA, 587 bp, Zea mays
  misc_feature (1)..(587): Ceres cDNA ID no. 22005827
  misc_feature (1)..(587): Ceres CLONE  ID no. 1518929
  misc_feature (1)..(587): Also known as  Ceres CDNA ID no. 22005827
aaaagacacaccgacgcgtacgtagcacagtccattattgccgtctcccttttgcgtgagcaaagaaagagagcgagaagcagtcgccatgtttggcatcatccacaagatcgaggagaagctccacatggggggcgaccacaagaataaggaggaggagtaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggagaagaaggacaagaagaagaaggataagaagaagcacggcgagggccacgaccacgacggcggccacagtagcagcagcagcgacagcgactgagatctggtgtcgcagcacaggtgcaacacaagtatgcttgctggatggaggattcataccagttgatgctgatgtagtgtttcactggtgtcatgcatgcatgtatcgtgctattataatcaaaaagaaaaaagaaataacagtcagggatggtttgtttgccatgtgataaaaaaaaaaaaaaaaa

SEQ ID NO: 5484 - protein, 103 aa, Zea mays
MFGIIHKIEEKLHMGGDHKNKEEEYHKKAEEHHKKEEGEHHKKDGGEHKEGIVEKIKDKITGEHGDKSGDHKEKKDKKKKDKKKHGEGHDHDGGHSSSSSDSD

SEQ ID NO: 5485 - DNA, 802 bp, Zea mays
  misc_feature (1)..(802): Ceres cDNA ID no. 22005828
  misc_feature (1)..(802): Ceres CLONE  ID no. 1522346
  misc_feature (1)..(802): Also known as  Ceres CDNA ID no. 24360722
aaccagccccttgcagttgcaggcggctgcaccttccccggccagctagctgcctgcctctcactcgagagtcacagagaccaccccctagctagggatggccgcagtgatgaaggctcttgctgtcgcctcgccggtgtcggcacgggcagcacagcatccccgtcggtaccacgtcgcaggtggccctaggcagcagcatcaacagcagaacttgtcgttgttccacggcgtgtcgtcggttcagtgccctgggcgatggcggcgggcgcaggtggtggcgatggcggcccggcccgcgatccagttcatccagggcacggacgagcagacggtcccggacgtgcggctgaccaagtcccgcgacggcaccaacggcgtggccgtcttcgcgctcgagcgtccgtcggtgttcgactcgtcggcggagctgggcgacatcacgggcttttacatggtggacgacgagggcgtgctgcagtccgtggacgtgagcgccaagttcgtgaacggcaagccggcgcggatcgaggccaagtacgtgatgcgcacgccccgggagtgggaccgcttcatgcgcttcatggagcggtactcccgggccaacggcctccagttcgtcaggaactgaatgaaagcaactcatgagcccgacgagcctgcctgcctgcctgctttgagctctctctctctctcgctgcctgtctgtctctttctcctctgcgcccctgtgtgagttggaatgcttttggattaacggccggattggaagaggactaaaaaaaaaaaaaaaaaaaaaaaa

SEQ ID NO: 5486 - protein, 802 aa, Zea mays
AACCAGCCCCTTGCAGTTGCAGGCGGCTGCACCTTCCCCGGCCAGCTAGCTGCCTGCCTCTCACTCGAGAGTCACAGAGACCACCCCCTAGCTAGGGATGGCCGCAGTGATGAAGGCTCTTGCTGTCGCCTCGCCGGTGTCGGCACGGGCAGCACAGCATCCCCGTCGGTACCACGTCGCAGGTGGCCCTAGGCAGCAGCATCAACAGCAGAACTTGTCGTTGTTCCACGGCGTGTCGTCGGTTCAGTGCCCTGGGCGATGGCGGCGGGCGCAGGTGGTGGCGATGGCGGCCCGGCCCGCGATCCAGTTCATCCAGGGCACGGACGAGCAGACGGTCCCGGACGTGCGGCTGACCAAGTCCCGCGACGGCACCAACGGCGTGGCCGTCTTCGCGCTCGAGCGTCCGTCGGTGTTCGACTCGTCGGCGGAGCTGGGCGACATCACGGGCTTTTACATGGTGGACGACGAGGGCGTGCTGCAGTCCGTGGACGTGAGCGCCAAGTTCGTGAACGGCAAGCCGGCGCGGATCGAGGCCAAGTACGTGATGCGCACGCCCCGGGAGTGGGACCGCTTCATGCGCTTCATGGAGCGGTACTCCCGGGCCAACGGCCTCCAGTTCGTCAGGAACTGAATGAAAGCAACTCATGAGCCCGACGAGCCTGCCTGCCTGCCTGCTTTGAGCTCTCTCTCTCTCTCGCTGCCTGTCTGTCTCTTTCTCCTCTGCGCCCCTGTGTGAGTTGGAATGCTTTTGGATTAACGGCCGGATTGGAAGAGGACTAAAAAAAAAAAAAAAAAAAAAAAA

SEQ ID NO: 5487 - DNA, 846 bp, Zea mays
  misc_feature (1)..(846): Ceres cDNA ID no. 22005831
  misc_feature (1)..(846): Ceres CLONE  ID no. 1524435
  misc_feature (1)..(846): Also known as  Ceres CDNA ID no. 22005831
aacgagcacgagactgctcggccgacgaaataataaagcgcgcgcgcgcacgcggagaggctcggagagctgagtgagatggcacaaaccatggcgtccatgaccggcctctcgcagggcgttctgcccagcaggcgcgccgccaacagggccaggacggccgccgtcgtcagggcgtccgccgaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactcttaactctgaccaggcgagggacttcgacctccccttgaaggagcggttctacctgcagccgctgccgccggcggaggcggtggcgagggtgaagacgtcggcgcaggacatcatcaacctcaagccgctcatcgacaagaaggcgtggccgtacgtccagaacgacctccgcctccgggcctcctacctgcgctacgacctcaagaccgtcatcgcttccaagcccaaggaggagaagcagagcctcaaggagctcaccggcaagctcttcagcaccatcgacgatcttgaccatgccgcaaagatcaagagcaccccggaggccgagaaatacttcgcagcaaccaaagatgcgctcggcgacgtcctcgccaagctagcctagatggaagctaatagatgggttaacgatggccacgtaatttcggacttgtgtttgttcatatggagccggcaaatgtaccgtttcctgttcatattatatcccgagttcttgacctaaaaaaaaaaaaaa

SEQ ID NO: 5488 - protein, 212 aa, Zea mays
MAQTMASMTGLSQGVLPSRRAANRARTAAVVRASAEAQAGRRAVLGLVATGIVGGALSQAVHAETVKTIKIGAPPPPSGGLPGTLNSDQARDFDLPLKERFYLQPLPPAEAVARVKTSAQDIINLKPLIDKKAWPYVQNDLRLRASYLRYDLKTVIASKPKEEKQSLKELTGKLFSTIDDLDHAAKIKSTPEAEKYFAATKDALGDVLAKLA

SEQ ID NO: 5489 - DNA, 1845 bp, Zea mays
  misc_feature (1)..(1845): Ceres cDNA ID no. 22005833
  misc_feature (1)..(1845): Ceres CLONE  ID no. 1529409
  misc_feature (1)..(1845): Also known as  Ceres CDNA ID no. 25088192
aagaaacactcgtggaaagcattagacaaatcagcacctgggcttgtcatcaaccgccgcgccgcgccgactagtcggtggccgtagcgcacctgtaccgcccgcaccgcgcggtcgaacacctcgcgcgcatccatggccaccacccacctcctcactccaccccgcgtccaccacccttccccctccgcttcctcctctgtggctcgcgtccgcgccaccgcctcgctcgcgcacccgctccacctctgccgcctccgcctcgccgccccgcgctcgcgctccccctccccgcggcacgggcggcgcgccatgtcggtccgcagctccctcatcgacccggacggcggcgcgctcgtcgagctcgtcgccccgcccgaccgcctcccggcgctgcgcgcggaggcggaggcgctcccgcgggtgcgcctcgcccccgtcgacctccagtgggcgcacgtgctcgccgaggggtgggccagcccgctccgcgggttcatgcgcgagcacgagtacctgcagagcctccacttcaactgcgttcgcctccccgacgggggcctcgtcaacatgtcgctccccattgtgctcgccatcggggacgccgacaaggagcagatcgggggtaagccggacgtcgcgttacaagggcccgacggcggtgtcgtcgccatcctgcgcagagttgaaatatatccccacaataaagaagaaagaatcgcaagaacatggggtacaactgcacctggtttaccctatgttgatgaggctattgcgtcagctgggaactggctgatcggtggcgatctggaggtgttggaacccatcaaatacaatgatggtcttgatcactacagactttcacctcggcaacttaggaaggagtttgacaagcggggggctgatgctgtgtttgccttccagttgagaaacccagtacacaatggtcatgcactattgatgaatgacactagaaggcgtctcttggaaatgggttacaagaatcccattctactactacatcccttaggtggttataccaaagcggatgatgtcccactgccagttagaatggaacaacacagtaaggttttagaagatggagtgcttgatcctgagactactatagtgtctatatttccctcaccaatgcattatgctggtccaacagaagtgcagtggcatgcaaaggcacgaattaatgctggtgccaatttctatatagtaggccgagatcctgctggaatgggacatccaacagaaaagagggacttgtacaacccagatcacgggaagaaggtcctgagcatggctcctggtttagagaaactcaacatactgcccttcaaggtagcagcttatgatacagtagcaaaggagatggccttttttgatccttcacgcagtcaagattttctgttcatctctggaaccaagatgcgcacttatgccaaaactggagagaatcctccagacggtttcatgtgcccgggtgggtggaaggttcttgttgactactacaacagcctgcaagctgaagaagcgactccagtccctgtatgaggcaagctactatttgactaagagattattcaatggcggggaaacatacaagcaagtgatcagatcatttgagcttttttccttattgattctttaggttagtagttgattgatatatgatcagatcttttcgattgtttgtttgtcttaaatatgagactctgaagcatggaaaaactaaagatctgcacaagttgagccaaaacagcatggccattgttctgtagcgaagccggttgaactatataataaaagatgaaagggtgcaaaaaaaaaaaaaaa

SEQ ID NO: 5490 - protein, 475 aa, Zea mays
  misc_feature: PFam Name: ATP-sulfurylase; PFam Description: ATP-sulfurylase
  misc_feature: PFam Name: FH2; PFam Description: Formin Homology 2 Domain
  misc_feature: PFam Name: Drf_FH1; PFam Description: Formin Homology Region 1
  misc_feature: PFam Name: Extensin_2; PFam Description: Extensin-like region
  misc_feature: PFam Name: Peptidase_S8; PFam Description: Subtilase family
  misc_feature: GI Number: 47086905; NR Description: 3'-phosphoadenosine 5'-phosphosulfate synthase 2 [Danio rerio] >gi|46250238|gb|AAH68346.1| 3'-phosphoadenosine 5'-phosphosulfate
  misc_feature: GI Number: 4033365; NR Description: ATP sulfurylase [Brassica
  misc_feature: GI Number: 6466851; NR Description: ATP sulfurylase precursor
  misc_feature: GI Number: 21554105; NR Description: ATP sulfurylase,
  misc_feature: GI Number: 7268174; NR Description: ATP-sulfurylase [Arabidopsis thaliana] >gi|2244824|emb|CAB10247.1| ATP-sulfurylase [Arabidopsis thaliana] >gi|15233537|ref|NP_193204.1| sulfate adenylyltransferase 3 / ATP-sulfurylase 3 (APS3) [Arabidopsis
MATTHLLTPPRVHHPSPSASSSVARVRATASLAHPLHLCRLRLAAPRSRSPSPRHGRRAMSVRSSLIDPDGGALVELVAPPDRLPALRAEAEALPRVRLAPVDLQWAHVLAEGWASPLRGFMREHEYLQSLHFNCVRLPDGGLVNMSLPIVLAIGDADKEQIGGKPDVALQGPDGGVVAILRRVEIYPHNKEERIARTWGTTAPGLPYVDEAIASAGNWLIGGDLEVLEPIKYNDGLDHYRLSPRQLRKEFDKRGADAVFAFQLRNPVHNGHALLMNDTRRRLLEMGYKNPILLLHPLGGYTKADDVPLPVRMEQHSKVLEDGVLDPETTIVSIFPSPMHYAGPTEVQWHAKARINAGANFYIVGRDPAGMGHPTEKRDLYNPDHGKKVLSMAPGLEKLNILPFKVAAYDTVAKEMAFFDPSRSQDFLFISGTKMRTYAKTGENPPDGFMCPGGWKVLVDYYNSLQAEEATPVPV

SEQ ID NO: 5491 - DNA, 1196 bp, Zea mays
  misc_feature (1)..(1196): Ceres cDNA ID no. 22005834
  misc_feature (1)..(1196): Ceres CLONE  ID no. 1530790
  misc_feature (1)..(1196): Also known as  Ceres CDNA ID no. 0
actaccataaaactcaactaaacatacaacttggatgatcatatccccagaaagatgatcccattcccatccaacctcgccttctaactaagcacactcttttatggctcttcagtttggctttggatttactgacttgagcaatgttaatttgcttttcttggggtagccgttttatatgtttctctaaagaatacatttggttgatgcagctcttggaacgggtgacgccagtcattctgaggaaaaaaccatcaggagatcttagaagaacgaactcaatgcagtggtagattggagccaagctcagtcgccgtctctttacagttataacatagaatttgcccctgtatgtcatttttctatttatatatgcgccaactaagttgtagtatcttagctgaaatagcatgggcaattagccgacacaaaggttaaacgaaatcatattatgtaggagtgctcatgaccaagaaaggttgctgttcctgcctgctcgtgtgttcattctgcctggtttatttttaagattttgttgtcaacatggcaggtaggtttggcaaggaagtagacaatcgtactccaataagcaggcctactttaagtgaaactgaaacgtcataatgctacgcagcgtctcggggcgcctacctgtggcttacctgcgtaaactgaaacatcgtaatgccagggagcttccagaggcgtgtaccttgttggtgcttgaatgatcaaaatattcaagataaagcgtgaacttgacgtgatatgatgactgctgagaccccattaataaaagataccaatgattggtacaagccaataccccttctggtgaccaaattcaattcaatttgctggatgaaatctggaataatcatgtttttcaagaaccataatggccaatgggcatgagttcgcatgctacttggtactggagagttaagaacagttcctcctgtaaacatcacattcttacagaaatggcaaaacacaacacatactgctgacttccggggctccagggcaccagatgaaggggatattgatcctatagctgcctagcatcagcaatgaagatacttccagactcgcaccaccctgctatcacatcattgttggcacactgcattgatttgaaaacaaggttgtcacaaacatataatattttttgccgcaagaaaaaaaaaaaaaaa

SEQ ID NO: 5492 - protein, 49 aa, Zea mays
MLICFSWGSRFICFSKEYIWLMQLLERVTPVILRKKPSGDLRRTNSMQW

SEQ ID NO: 5493 - DNA, 973 bp, Zea mays
  misc_feature (1)..(973): Ceres cDNA ID no. 22005835
  misc_feature (1)..(973): Ceres CLONE  ID no. 1531862
  misc_feature (1)..(973): Also known as  Ceres CDNA ID no. 24391163
aatcgacaaaatggaggtaccgcgcctcccccagggtgcccttccatccatggcgttgccgcggccgtccccgcaatcaactcccagatctcgtgctcacctccccgcaatcaaggtcgtcacgcccgatgaggatggccgcgagtcgccgcacggcggtccgggccccagcgatagctccggcgcaggcgcgaggaagaagctccggctcaccaatgagcagtcgacgctgctcgaggacaccttccgcgcccacaacatactctccaacgcgcagaagcaggagctcggacggcaggtggatctcagcgccaggcaggtggaagtgtggttccagaacacacatgttcagataacacacatgttcatgctcatgctgaccccacacagtgggattttcccagcaatcagcttgataggcgacatcatcattgtcgggatcttctacttcattggatttgcattgttctgcttggaggcttttctgaacatgtgggtcattcagcttttgcacccttctgatcaattcagaagagaacccggagaaccatgcacttgtggagttgttcatctggaaagtgacaccattattgaatatgattgatcgactttggggtcaatagtggcacaacaaggttctccatcgactcaagaaccaagctgttaatgaggacacctttcggtgttcatatgagtttggatggaaacctcgggttgctttgttgtccaattcctgttaatgttatctacacttacaaataaacgttgttgttgcattttgatgagtttcatttgttcctgtgcagagggcctcctattgtgccctctgacagaagcatctcacggacgagagaggtaaggatttgatatgtttgatttgatggacgcttgttgaattatctgtgcagtcttcgtttaatgtgtccaaatattttcttaaaaaaaaaaaaaaaaaaaaaaaaaaaaaaaaaaa

SEQ ID NO: 5494 - protein, 973 aa, Zea mays
  misc_feature: PFam Name: Homeobox; PFam Description: Homeobox domain
  misc_feature: PFam Name: SCAMP; PFam Description: SCAMP family
  misc_feature: GI Number: 51535962; NR Description: putative homeodomain
  misc_feature: GI Number: 53793238; NR Description: putative homeodomain
  misc_feature: GI Number: 20271001; NR Description: HAT4 [Arabidopsis lyrata
  misc_feature: GI Number: 27752797; NR Description: HAT4 [Arabidopsis lyrata] >gi|27752795|gb|AAO19412.1| HAT4 [Arabidopsis lyrata] >gi|27752793|gb|AAO19411.1| HAT4 [Arabidopsis lyrata] >gi|27752791|gb|AAO19410.1| HAT4 [Arabidopsis lyrata]
  misc_feature: GI Number: 27752847; NR Description: HAT4 [Arabidopsis thaliana] >gi|27752845|gb|AAO19437.1| HAT4 [Arabidopsis thaliana] >gi|27752843|gb|AAO19436.1| HAT4 [Arabidopsis thaliana]
AATCGACAAAATGGAGGTACCGCGCCTCCCCCAGGGTGCCCTTCCATCCATGGCGTTGCCGCGGCCGTCCCCGCAATCAACTCCCAGATCTCGTGCTCACCTCCCCGCAATCAAGGTCGTCACGCCCGATGAGGATGGCCGCGAGTCGCCGCACGGCGGTCCGGGCCCCAGCGATAGCTCCGGCGCAGGCGCGAGGAAGAAGCTCCGGCTCACCAATGAGCAGTCGACGCTGCTCGAGGACACCTTCCGCGCCCACAACATACTCTCCAACGCGCAGAAGCAGGAGCTCGGACGGCAGGTGGATCTCAGCGCCAGGCAGGTGGAAGTGTGGTTCCAGAACACACATGTTCAGATAACACACATGTTCATGCTCATGCTGACCCCACACAGTGGGATTTTCCCAGCAATCAGCTTGATAGGCGACATCATCATTGTCGGGATCTTCTACTTCATTGGATTTGCATTGTTCTGCTTGGAGGCTTTTCTGAACATGTGGGTCATTCAGCTTTTGCACCCTTCTGATCAATTCAGAAGAGAACCCGGAGAACCATGCACTTGTGGAGTTGTTCATCTGGAAAGTGACACCATTATTGAATATGATTGATCGACTTTGGGGTCAATAGTGGCACAACAAGGTTCTCCATCGACTCAAGAACCAAGCTGTTAATGAGGACACCTTTCGGTGTTCATATGAGTTTGGATGGAAACCTCGGGTTGCTTTGTTGTCCAATTCCTGTTAATGTTATCTACACTTACAAATAAACGTTGTTGTTGCATTTTGATGAGTTTCATTTGTTCCTGTGCAGAGGGCCTCCTATTGTGCCCTCTGACAGAAGCATCTCACGGACGAGAGAGGTAAGGATTTGATATGTTTGATTTGATGGACGCTTGTTGAATTATCTGTGCAGTCTTCGTTTAATGTGTCCAAATATTTTCTTAAAAAAAAAAAAAAAAAAAAAAAAAAAAAAAAAAA

SEQ ID NO: 5495 - DNA, 2003 bp, Zea mays
  misc_feature (1)..(2003): Ceres cDNA ID no. 22005838
  misc_feature (1)..(2003): Ceres CLONE  ID no. 1532783
  misc_feature (1)..(2003): Also known as  Ceres CDNA ID no. 24386553
agaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaacagatgccggcgccgctggcggtggcggacgatgcatggaggacttcttcgactgcctcctcggcttgctcggcgcgttaggcatgacatgggctgcggcgcggccccagcggcagccgcgcccgccgctgcctcgcggggctgcgggggcggggcctgcgccaactgactcccggcgtttcgcggcggagctcagggccacccccggccggatcgccggcaatggcgcctgcgccgtcgcgtcactgtacacgctgcagggcaagaagggcgtcaaccaggatgctatgatcttctgggagaacttctgttcaagagatgataccatcttttgtggtgtgtttgacggccatggaccttatggccatttggttgccaagagagtaagagatctgctgcctctaaagttaggagaaggtttgacgacggaagatggtagagtaacatccactggcaacattaagctcaacacacatgatgtagcttcaccagaacacatagacaaaggaagtactgccatttcctctgaagctcagcagaatggagagtatccagagaccttcccagcattgagaacttcattcttgaaggcattccgtgtaatggatagggatctcaaattacataaaagcattgactgctttttcagtgggactacagcggtggcagtgatcaagcaggaacacaatcttataattggcaatttgggggattcaagagctgtcttaggcaccagagatgaaaataaccagcttattgctgttcaattgacagttgatctcaaacctaacattccaagcgaagcacagagaatcaggcaacgcaggggcagaatattcgcgcttcccgaggagccggaggttgctcgtgtttggcttccaaagtacaactctcctggactggccatggctagggcatttggagacttctgtctgaaggaccatggtgtaatttctacgcctgacgtctcctatcaccacatcacggagaaagacgaatttgtggtgctggctactgacggggtctgggacgtgctatcaaacgatgaggttgttagcactgtctgccgagccacatctcaggcctctgcagcccggtttctcgtcgagtcggctcaccgcgcttggcggactcggttccccacttctaagatcgatgactgcgctgttgtctgcctgttcctgaacacagacaaagcgagcgaatcgtcgagttctttggccaagaacttggcagatgctgtagaagctagcagtgctgggcgcgccacaactgtccaggtgagcgctggtgcatctacagatgttgccgccctggtaccagtaccagatgggaacgaggtgtctattgctgaaaccatcacaaagctggtcatgctcatggatttgcccaaggatggttgaggctcctgtgattgggacctgaacgaagatataccacatcggtgggtttctgcttgcagtttttttttctgaacgcaagtgtggctagaatttgcagttttgcttcgtgtaaagtaccgcgtcagtttagcgtgatttgttccagtttttgtaatatttcaattcatgttagtattgatgcgtccgtgcgtcgtcgagatcgtagtattctgtaggaaggaggctactgagtttttgtgcttcctgtaaatatattcatcattcaaaaaaaaaaaaaaaaa

SEQ ID NO: 5496 - protein, 2003 aa, Zea mays
  misc_feature: PFam Name: Cation_efflux; PFam Description: Cation efflux family
  misc_feature: GI Number: 34902474; NR Description: Putative leucine-rich repeat transmembrane protein kinase [Oryza sativa (japonica cultivar-group)] >gi|22748334|gb|AAN05336.1| Putative leucine-rich repeat transmembrane protein kinase [Oryza sativa
  misc_feature: GI Number: 8778688; NR Description: T1N15.9 [Arabidopsis thaliana] >gi|25405930|pir||G96524 protein T1N15.9 [imported] - Arabidopsis thaliana >gi|18402209|ref|NP_564528.1| leucine-rich repeat transmembrane protein kinase, putative [Arabidopsis
  misc_feature: GI Number: 4008006; NR Description: receptor-like protein
  misc_feature: GI Number: 50918255; NR Description: putative receptor kinase [Oryza sativa] >gi|13324792|gb|AAK18840.1| putative receptor kinase
  misc_feature: GI Number: 37778684; NR Description: atypical receptor-like
AGAATCAGCAGCAGCAACTCTCTCCCTCTCCGTTCTTGGTGGTCCGAGACCCTTGGCCGTACGCTCTGCCTCACTCCTCCGTCTCTTGCTTCCCTTGCCGCCGGCGGCGCGCGGCGCCGGGCGCGGATCGGCGGCGGGTGCATGGTGGAGGCCGCCGCCGGGCGCCGGACAGGCACCAGCCGTCGGCGGCCTAGCGGCAGCGGAGGGGAGCACCGGCACCTGGTCGCGCTCGCCGTCGCCGCGCGCGTCGCCATGGTCACCACCCGGTCCGTGGGTCCAGCAGCAGTAGCGGAAGGTGATGGAGCGGGAGCTGCTGTAACAGATGCCGGCGCCGCTGGCGGTGGCGGACGATGCATGGAGGACTTCTTCGACTGCCTCCTCGGCTTGCTCGGCGCGTTAGGCATGACATGGGCTGCGGCGCGGCCCCAGCGGCAGCCGCGCCCGCCGCTGCCTCGCGGGGCTGCGGGGGCGGGGCCTGCGCCAACTGACTCCCGGCGTTTCGCGGCGGAGCTCAGGGCCACCCCCGGCCGGATCGCCGGCAATGGCGCCTGCGCCGTCGCGTCACTGTACACGCTGCAGGGCAAGAAGGGCGTCAACCAGGATGCTATGATCTTCTGGGAGAACTTCTGTTCAAGAGATGATACCATCTTTTGTGGTGTGTTTGACGGCCATGGACCTTATGGCCATTTGGTTGCCAAGAGAGTAAGAGATCTGCTGCCTCTAAAGTTAGGAGAAGGTTTGACGACGGAAGATGGTAGAGTAACATCCACTGGCAACATTAAGCTCAACACACATGATGTAGCTTCACCAGAACACATAGACAAAGGAAGTACTGCCATTTCCTCTGAAGCTCAGCAGAATGGAGAGTATCCAGAGACCTTCCCAGCATTGAGAACTTCATTCTTGAAGGCATTCCGTGTAATGGATAGGGATCTCAAATTACATAAAAGCATTGACTGCTTTTTCAGTGGGACTACAGCGGTGGCAGTGATCAAGCAGGAACACAATCTTATAATTGGCAATTTGGGGGATTCAAGAGCTGTCTTAGGCACCAGAGATGAAAATAACCAGCTTATTGCTGTTCAATTGACAGTTGATCTCAAACCTAACATTCCAAGCGAAGCACAGAGAATCAGGCAACGCAGGGGCAGAATATTCGCGCTTCCCGAGGAGCCGGAGGTTGCTCGTGTTTGGCTTCCAAAGTACAACTCTCCTGGACTGGCCATGGCTAGGGCATTTGGAGACTTCTGTCTGAAGGACCATGGTGTAATTTCTACGCCTGACGTCTCCTATCACCACATCACGGAGAAAGACGAATTTGTGGTGCTGGCTACTGACGGGGTCTGGGACGTGCTATCAAACGATGAGGTTGTTAGCACTGTCTGCCGAGCCACATCTCAGGCCTCTGCAGCCCGGTTTCTCGTCGAGTCGGCTCACCGCGCTTGGCGGACTCGGTTCCCCACTTCTAAGATCGATGACTGCGCTGTTGTCTGCCTGTTCCTGAACACAGACAAAGCGAGCGAATCGTCGAGTTCTTTGGCCAAGAACTTGGCAGATGCTGTAGAAGCTAGCAGTGCTGGGCGCGCCACAACTGTCCAGGTGAGCGCTGGTGCATCTACAGATGTTGCCGCCCTGGTACCAGTACCAGATGGGAACGAGGTGTCTATTGCTGAAACCATCACAAAGCTGGTCATGCTCATGGATTTGCCCAAGGATGGTTGAGGCTCCTGTGATTGGGACCTGAACGAAGATATACCACATCGGTGGGTTTCTGCTTGCAGTTTTTTTTTCTGAACGCAAGTGTGGCTAGAATTTGCAGTTTTGCTTCGTGTAAAGTACCGCGTCAGTTTAGCGTGATTTGTTCCAGTTTTTGTAATATTTCAATTCATGTTAGTATTGATGCGTCCGTGCGTCGTCGAGATCGTAGTATTCTGTAGGAAGGAGGCTACTGAGTTTTTGTGCTTCCTGTAAATATATTCATCATTCAAAAAAAAAAAAAAAAA

SEQ ID NO: 5497 - DNA, 1541 bp, Zea mays
  misc_feature (1)..(1541): Ceres cDNA ID no. 22005839
  misc_feature (1)..(1541): Ceres CLONE  ID no. 1536888
  misc_feature (1)..(1541): Also known as  Ceres CDNA ID no. 24360639
aagtgcatcccatgtctgcaatctacatgagccagctctccactgccctccctctcatggagggagatcaccaagatcatcatcaccaccaccaaggccacttccaggccttcaccctgccaaaggaaacaccgatccttttcccctttgtgatcagcaatagtagcgccagcgaaggcagtttgagctatggatcggctgcagaccatcacttgttgaggcagcgtcatcaagctatgctggagccccaacatatgattggaggatcatcaactgcgactgggaatagtgtcttctcgacgccgttcccgaccgtggagagcatccgcgacgacatgatcgagcctgcctcgtacgatccatacgacatggggaagctgcaggtcggcgggtcgatggatgcttgcagctggacgccggcggcagccaagatgaggatcacgaggaaggccactgccgatcccagtgcggggaagaagccaaggagaagggcgcaagcagggtacgacgacaccatgagcggccaaccgaatttgggtgttattagggtgtgctccgactgcaacaccaccaagacacccttgtggaggagtggtccttgcggccccaagtcgctctgcaacgcgtgcggtatcaggcagcggaaggcgaggcgggcgatgatggccgccgcctccggctcggtgtcagcagttcccactgacagcggcaaggcctcgcccagcaacgccgccgtggccgcagcagcagcacaccccaaggtgaagaaggagaagagagtggacgtggaccggtcgctgccgttcaagaaacggtgcaaggtggtccagcaaggtcacggtgcggccgtcgtcgttgcagctcctgctgctgccaccgacagcgcgactgtcgtgcaggccaccgccgaggatggtgatgacgacacctgtccgagcagggatctgcttgtcgacgacattggtgggctcatcagctggagcaggagtccggcggcacccgcctcagcggctgcggccacgtgcagcttccgggcgtcgccggcgttgtccgtgcagcaggacgagatcacggacgctgccatgctgctgatgacgctgtcctgcgggcttgtccggagctgatcgcctgatccacgatctgctacctctacgaaggacgacccagcgcaccgtaggcttttcccagctagcagctagcttgtgcctttgactgttagctagcgttactgttactgctgttaccatcgtcgtctaccgtaatacctgtagtgcttttgtttagcttcttgttgctagtgtgaccacccgtgtcactgttcaagtcatgtgattcgttcgatgagtgagagagagagaagaggtctagttgagatgataggagcgacaagagcaccgtctctagctacaatagctagtaaatataatcgcatgtagtgtgaggagtttcagttttgagtgtgtacaagttctttaattccgatcctgtggctataatctggtcgctggctgctgctaaaaaaaaaaaaaaaaaaaaaaaaa

SEQ ID NO: 5498 - protein, 370 aa, Zea mays
  misc_feature: PFam Name: GATA; PFam Description: GATA zinc finger
  misc_feature: GI Number: 50906397; NR Description: zinc finger protein-like [Oryza sativa (japonica cultivar-group)] >gi|46806488|dbj|BAD17612.1| zinc finger protein-like [Oryza sativa
MSAIYMSQLSTALPLMEGDHQDHHHHHQGHFQAFTLPKETPILFPFVISNSSASEGSLSYGSAADHHLLRQRHQAMLEPQHMIGGSSTATGNSVFSTPFPTVESIRDDMIEPASYDPYDMGKLQVGGSMDACSWTPAAAKMRITRKATADPSAGKKPRRRAQAGYDDTMSGQPNLGVIRVCSDCNTTKTPLWRSGPCGPKSLCNACGIRQRKARRAMMAAASGSVSAVPTDSGKASPSNAAVAAAAAHPKVKKEKRVDVDRSLPFKKRCKVVQQGHGAAVVVAAPAAATDSATVVQATAEDGDDDTCPSRDLLVDDIGGLISWSRSPAAPASAAAATCSFRASPALSVQQDEITDAAMLLMTLSCGLVRS

SEQ ID NO: 5499 - DNA, 1813 bp, Zea mays
  misc_feature (1)..(1813): Ceres cDNA ID no. 22005842
  misc_feature (1)..(1813): Ceres CLONE  ID no. 1542105
  misc_feature (1)..(1813): Also known as  Ceres CDNA ID no. 24391589
aagccaggcaaagaggccgaggccgaggccgcgcgcacgatataagcagcaccgccatcgctccacgcttcttggtaggtcgccggtcagcaggagcagcagcggcggcggcggggagaaggctgctaactggtggccggccgttcgccgcgagctccggcacgcctccggtccggcggacggcagcagcagcatgtcttcggccgccccgctgctaggcgacgaggccggcggtggcgagcccgcgccgcggacgccgccgccgccgtcctcgtgggtggggcgcgtggtggacgcggccgaggcgcgcgcgcagctggggttcgcggtgccgatggtgctgaccagcatggcctactacggcatcccgctggtgtcggtgatgttctcgggccagctcggcgacgtccacctcgccggcgccacgctcggcaactcctgggccaccgtcaccggctacgcgttcgtgaccggtctgagcggcgccctggagacgctgtgcgggcaggcgtacggcgcggggctgcaccgcatgctgggcctctacctgcagtcgtcgctcatcatgtcggccgccgcgtcggcgctcgtctccgcgctgtggtggttcacggagccggtgctcctgctcctgcggcaggagcccgaggcgtcccgcgccgcggcggcgttcgtccgcgcgcaggcgcctggcctcttcgccttctccttcgtgcagtgcctgctccgctacctgcagacgcagtccgtcgtgctcccgctcgtcgcctgctccgtggccccgttcgcgctccacgtcgcgctggcgcacctcatggtcaacgtgctcggcctgggcctcacgggggcggccgccgccgtctcggccacgttctgggtctcctgcctcatgctgctcgcctacgtgctgcgctccgacgccttcagcgacacgtggaggggcttctctgccgacgccttcaagtacgtgctgcccaccgtgaagctcgccacgccgtccgccgtcatggtctgcttggagtactgggcattcgagctcctggtcctgatcgccggattgcttcccaactccacagtgagcacgtctctcatcgccatgtgctccagcacggaggcgatcgcgtacatgatcacgttcggcttcagcgccgccgtgagcacgcgggtgtcgaacgagatcggcgcggggaacgtggagagggccaagaacgcggtgtcggtgacgatgaagctgtcggtgttgctggccgtcaccttcgtgctgctgctggcgttcggccacggcctgtgggcgcgcctcttcagcgggagcgccaccatcgcgtcggagttcgcggccatcacgccgctcatggtgatctccatcgtgctggactccgtgcagggcgtgctgtcgggagtggcgaggggctgcgggtggcagcacctggcggcggtcaccaacctggtggcgttctacatcgtcggcatgccgctggccatcctgttcgccttcaagctcgacctgcgcaccaggggcctgtgggcggggctcatctgcggcctcacgtgccaggcctgctcgctgctggtcatcaccgtccgcaccaagtggtccaagctcgccgatgccatgaaggaggagaaggccaactacgtcgcgtagcaaacgcactctacgtctgtactgcctttttttttggggagataaagagcacactacagtacgatcattttagacggcttgccgacgaaaatagatcatatgatgctaaaaatagtctatttttttggtatatagcttatttttggtggtcaaaaaaaaaaaaaaaaa

SEQ ID NO: 5500 - protein, 483 aa, Zea mays
  misc_feature: PFam Name: MatE; PFam Description: MatE
  misc_feature: PFam Name: Peptidase_S8; PFam Description: Subtilase family
  misc_feature: PFam Name: Keratin_B2; PFam Description: Keratin, high
  misc_feature: GI Number: 50937475; NR Description: putative MATE efflux protein family protein [Oryza sativa (japonica cultivar-group)] >gi|34394668|dbj|BAC83974.1| putative MATE efflux protein family
  misc_feature: GI Number: 34899388; NR Description: putative ripening regulated protein DDTFR18 [Oryza sativa (japonica cultivar-group)] >gi|23617058|dbj|BAC20746.1| putative ripening regulated protein
  misc_feature: GI Number: 16797803; NR Description: hypothetical membrane
  misc_feature: GI Number: 52077396; NR Description: putative ripening
  misc_feature: GI Number: 52077421; NR Description: putative ripening
MSSAAPLLGDEAGGGEPAPRTPPPPSSWVGRVVDAAEARAQLGFAVPMVLTSMAYYGIPLVSVMFSGQLGDVHLAGATLGNSWATVTGYAFVTGLSGALETLCGQAYGAGLHRMLGLYLQSSLIMSAAASALVSALWWFTEPVLLLLRQEPEASRAAAAFVRAQAPGLFAFSFVQCLLRYLQTQSVVLPLVACSVAPFALHVALAHLMVNVLGLGLTGAAAAVSATFWVSCLMLLAYVLRSDAFSDTWRGFSADAFKYVLPTVKLATPSAVMVCLEYWAFELLVLIAGLLPNSTVSTSLIAMCSSTEAIAYMITFGFSAAVSTRVSNEIGAGNVERAKNAVSVTMKLSVLLAVTFVLLLAFGHGLWARLFSGSATIASEFAAITPLMVISIVLDSVQGVLSGVARGCGWQHLAAVTNLVAFYIVGMPLAILFAFKLDLRTRGLWAGLICGLTCQACSLLVITVRTKWSKLADAMKEEKANYVA

SEQ ID NO: 5501 - DNA, 942 bp, Zea mays
  misc_feature (1)..(942): Ceres cDNA ID no. 22005843
  misc_feature (1)..(942): Ceres CLONE  ID no. 1542108
  misc_feature (1)..(942): Also known as  Ceres CDNA ID no. 24387122
aactccacgttccgtgtttccgactctggtgactccaccaccagcaacccgtgcagcgagcgcactccgaccatcgccatgtcgaggcgcggcgactgggtctacgagaacaacggcgggacctgcgtggccatcgccggcgctgattactgtgtcgtcgctgcggacacccgcctctctgtaggatacagtatcctcacgcgtgatcactccaagatctgcgacctggctgacaaatgtgtactggcatcttctggctttcaaggtgatattaaggctctgcagaagaacctagctgccagagaattgctgtaccaacaccagcataataaaaggatgagctgccccgccatggcacagctcctctccaataccctgtactacaagcgattcttcccatattacgccttcaatgtgctcggtgggcttgacagcgaggggaaaggatgcgttttcacctatgatgcagtaggttcctacgagagaaccggttacagtgctcagggaacgggatctactttgatcatgccagtcctggacaatcaactaaaatcaccaagtcctctattactccctgtcagggatgctgtcacaccattgtcggagtcagaggccatcgatctagttaagggcgtgttcgcatctgcaactgagagagacatctacactggagacaagttggaaattgtagtcattaacaaggccggtactaagcgcgagtatatcgacctgagaaaggattaagccaacacttcagttgtgctgcagctgtcatttgctttgaactttttttttcctagtctggtgatttatgtctaaagctgttgcttcataggaacacttgtgtttacttgcatatgtaatgtacggtatgtaccaggattcagtgagtttttttctgttgaaacaaattgcttggatactgaaaaaaaaaaaaaaaaa

SEQ ID NO: 5502 - protein, 221 aa, Zea mays
  misc_feature: PFam Name: Proteasome; PFam Description: Proteasome A-type
  misc_feature: GI Number: 50947863; NR Description: putative proteasome subunit beta type 1 [Oryza sativa (japonica cultivar-group)] >gi|42407968|dbj|BAD09106.1| putative proteasome subunit beta type
  misc_feature: GI Number: 17380182; NR Description: Proteasome subunit beta type 1 (20S proteasome alpha subunit F) (20S proteasome subunit beta-6) >gi|3138799|dbj|BAA28276.1| beta 6 subunit of 20S
  misc_feature: GI Number: 21554745; NR Description: proteasome component C5 [Arabidopsis thaliana] >gi|577531|emb|CAA56201.1| proteasome subunit [Arabidopsis thaliana] >gi|7329692|emb|CAB82686.1| proteasome component C5 [Arabidopsis thaliana]
  misc_feature: GI Number: 600387; NR Description: proteosome subunit
  misc_feature: GI Number: 14594933; NR Description: putative beta6
MSRRGDWVYENNGGTCVAIAGADYCVVAADTRLSVGYSILTRDHSKICDLADKCVLASSGFQGDIKALQKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPVRDAVTPLSESEAIDLVKGVFASATERDIYTGDKLEIVVINKAGTKREYIDLRKD

SEQ ID NO: 5503 - DNA, 977 bp, Zea mays
  misc_feature (1)..(977): Ceres cDNA ID no. 22005844
  misc_feature (1)..(977): Ceres CLONE  ID no. 1542330
  misc_feature (1)..(977): Also known as  Ceres CDNA ID no. 23844526
actagaaaaagacgacgtcgcggcaattggcagctcggacgatggcgtccaactccgcggccccggctgccgccgacgggggcgacgacctcgaccagctcctcgacagcgcgctcgacgacttcaccagcctcgacctctccgcctctgccgcccccaaaagcgccggtgaggcatcggggtcaggatcgggaggcaaggggccggtgaaggggctggggctggggcttccggaccccaaggtgccgaagcggcgcgcggggaagcagccaccgccgaggggcgcgtgcgccaaagaggcgcttgaggagctgacgcgcgagacgcgggaggctgtgcgcgagctcgagacggccactgggggtgttccgtcactggacgatgacgccatgatggaggagttcgtcaaacagtttgaggagttcgcaggggcacaggatatggactccattgttgaaacaatgatgcggcagcttttgtccaaggagattcttcatgagcccatgaaggacattgtggagaaatatccaaaatggctggaggataataaaaacaagataagcaaagaagaatatgagcgttataataatcagctagaactcatggtgaagcttattgaggtctatgaaaatgatcctgagaacatgactaagatttttgacatcattcaaaacatgcaagaatgtggtcagccccccagtgatcttgtccaagatgctgtacctgatctggatctgagcaagttgggacagctgtctcctgagatgcttgaatcagcaccaaattgttgcgtaatgtgaagacaaaaaacattccacttgggattcaattccatgaagtttcttaacctgtacgaaccccctcccccctttctggcttgagtagattcaagataatttccatctggataatctgtaaagccttgcaaatatataatgggctcaatgttctttctggttcaaaaaaaaaaaaaaaaa

SEQ ID NO: 5504 - protein, 252 aa, Zea mays
  misc_feature: PFam Name: Pex19; PFam Description: Pex19 protein family
  misc_feature: GI Number: 50911507; NR Description: peroxisomal protein PEX19-like [Oryza sativa (japonica cultivar-group)] >gi|49388497|dbj|BAD25621.1| peroxisomal protein PEX19-like [Oryza sativa (japonica cultivar-group)]
  misc_feature: GI Number: 23506147; NR Description: At5g17550/K10A8_30 [Arabidopsis thaliana] >gi|15294212|gb|AAK95283.1| AT5g17550/K10A8_30 [Arabidopsis thaliana] >gi|18418341|ref|NP_568351.1| peroxisomal protein PEX19 family
  misc_feature: GI Number: 62531044; NR Description: Unknown (protein for
  misc_feature: GI Number: 34784026; NR Description: Wu:fb99a01 protein
  misc_feature: GI Number: 62026746; NR Description: Unknown (protein for
MASNSAAPAAADGGDDLDQLLDSALDDFTSLDLSASAAPKSAGEASGSGSGGKGPVKGLGLGLPDPKVPKRRAGKQPPPRGACAKEALEELTRETREAVRELETATGGVPSLDDDAMMEEFVKQFEEFAGAQDMDSIVETMMRQLLSKEILHEPMKDIVEKYPKWLEDNKNKISKEEYERYNNQLELMVKLIEVYENDPENMTKIFDIIQNMQECGQPPSDLVQDAVPDLDLSKLGQLSPEMLESAPNCCVM

SEQ ID NO: 5505 - DNA, 1911 bp, Zea mays
  misc_feature (1)..(1911): Ceres cDNA ID no. 22005845
  misc_feature (1)..(1911): Ceres CLONE  ID no. 1542852
  misc_feature (1)..(1911): Also known as  Ceres CDNA ID no. 24386197
aatcacacctctcgaccgcccccttctctttcatcaatcaaggatcacagagctgccaaagccagaggagcgttatcagagcagggaggaagaagagcgttgtgttcgacgcaggagaatttcgagggacagcgactcgactcgactcgaagctctggagagatctagcggggctccggtgcagccgatgcatggcaactcgcaagggctgagctgctcgtcactggcgtaggaaagtgccgtcgtcgccatggacagggacagcagctcgtcggtctcggcgtcggacgggagctcggaggcgggggagcgcggcgggtgctgctcgtcgccgccgtccacgcggagcctcgtcgacacggcgggcaacaacctcatcagccgcaccgcgtccgacgcgtccacgtccctctcggaccggtgcagcagcgtcgacgtcgaccacagcgggccgttccagcccgccgccgccgtggccaagctcatcggccggtcgtccccgccgtccgccgccgcgtcgctcagacggctcagcatcaagccccgcgccgacgtgctcgaccgccgctccaccgaggacgagatggagctggtgaaggagcgcttctctaagctcctgctgggcgaggacatgtccggcggcggcaagggcgtctgcaccgccgtcgccatctccaacgccatcaccaacctctacgcgacggtgttcgggagctgccacaagttggagccgctgccggcggggaagaaggcgatgtggacaagagagatggactgcctcctctccgtctgcgactacatcgtccagttctacccgtccacgcagaccctgcccgatgggaccaaagttgaggtcatggcgaccagaccaaggtcggacatctacatcaaccttcccgcgctcgagaagctcgacgccatgctcatcgacattctggacagcttccagaaggcggagttctggtacgcggacgccgggacgaggtcgttcggctcggtcacctcgtcctcgtcgtcgaggatgtcgtgttcgtcgtcattcaggaggtcggctcaccggaacgacgataagtggtggctgccggtgccctgcgtcccggacgccggcctcaccgacaaggcgcgcaaggacctgcagcagaggcgcgactgcgccaaccagatccacaaggccgctgtctccatcaacagcggcgtcctcggagacatggaggtgccggagtcgttcatggccgtgctccccaagagcggtcgggcaagcgtgggggactcggtgtaccgcgtcatgcttggcgccgacaagttctcgccggagttcctgctcgacacgcttgacatctcgtcggagcacgacgcgctggcgatggccgaccgggtggaggccgccatgtacgtgtggcggcgcaaggctagcggcagccacggcaagctgccgtggagcaaggtcaaggagctcgcggccgacgacgacgacaagaacgtgacgctggccaacagggccgagagcctcctgctctgcatcaagcaccgcttccctggcctgtcgcagaccaccctggacaccagcaagatccagttcaacaaggatgttgggcaagcgatcctggagagctactcgagggtgttggagagcttggctttcaacattgtttcgtggatcgatgatgtccttttcgtcgacaggtcgataaggaaactgagtgataacctcaagtcctgagttctttatcctgcactgaagcttcccagcaaaaaggttttagatgtctgttggtgaagctgcagaagaagggtgcgtgactgtagtagcggtagtagggtgattttgctgacctagagagatgcaagcctctagctttgcaagaatgcacaatgcagagtagcgtgtctgatcaaaaaaaaaaaaaaaaa

SEQ ID NO: 5506 - protein, 489 aa, Zea mays
  misc_feature: PFam Name: 7tm_1; PFam Description: 7 transmembrane receptor
  misc_feature: GI Number: 34908302; NR Description: P0005H10.23 [Oryza sativa (japonica cultivar-group)] >gi|15408895|dbj|BAB64286.1|
  misc_feature: GI Number: 34911076; NR Description: P0485G01.25 [Oryza sativa (japonica cultivar-group)] >gi|21104734|dbj|BAB93322.1| OJ1117_G01.5 [Oryza sativa (japonica cultivar-group)] >gi|21644632|dbj|BAC01191.1| P0485G01.25 [Oryza sativa (japonica
  misc_feature: GI Number: 66776896; NR Description: LigA [Anaeromyxobacter dehalogenans 2CP-C] >gi|66857361|ref|ZP_00401413.1| LigA
  misc_feature: GI Number: 5821151; NR Description: RNA binding protein [Homo
  misc_feature: GI Number: 6634015; NR Description: KIAA0324 protein [Homo sapiens]
MDRDSSSSVSASDGSSEAGERGGCCSSPPSTRSLVDTAGNNLISRTASDASTSLSDRCSSVDVDHSGPFQPAAAVAKLIGRSSPPSAAASLRRLSIKPRADVLDRRSTEDEMELVKERFSKLLLGEDMSGGGKGVCTAVAISNAITNLYATVFGSCHKLEPLPAGKKAMWTREMDCLLSVCDYIVQFYPSTQTLPDGTKVEVMATRPRSDIYINLPALEKLDAMLIDILDSFQKAEFWYADAGTRSFGSVTSSSSSRMSCSSSFRRSAHRNDDKWWLPVPCVPDAGLTDKARKDLQQRRDCANQIHKAAVSINSGVLGDMEVPESFMAVLPKSGRASVGDSVYRVMLGADKFSPEFLLDTLDISSEHDALAMADRVEAAMYVWRRKASGSHGKLPWSKVKELAADDDDKNVTLANRAESLLLCIKHRFPGLSQTTLDTSKIQFNKDVGQAILESYSRVLESLAFNIVSWIDDVLFVDRSIRKLSDNLKS

SEQ ID NO: 5507 - DNA, 1997 bp, Zea mays
  misc_feature (1)..(1997): Ceres cDNA ID no. 22005846
  misc_feature (1)..(1997): Ceres CLONE  ID no. 1545993
  misc_feature (1)..(1997): Also known as  Ceres CDNA ID no. 24386369
aaccggtgaagagcgctccgctgccgtgcgcgcccccgcgccggcctcccactggatcgctccacctcatgctccaaatctttattggtttccacgttgccccctcgccgtccccaaccatcgaccgcgccgcgcccgctgccgcctcccagctcgctctatataaacaccacgtacgcgccgaagcatcagcacagccacgtacgtacgaccggcttccggcaggtgagagaacagtgagaagcaggcgagcggtgacatggcggagggggagttcaagcccgcggcgatgcaggtggaggctcctgccgaggcggcggcggcgccgtccaagccgcggttcaggatgcccgtcgactccgacaacaaggccaccgagttctggctcttctccttcgcgaggccgcacatgagcgccttccacatgtcgtggttctccttcttctgctgcttcctctccaccttcgcggcgccgccgctgctcccgctcatccgggacacgctggggctcacggccacggacatcggcaacgccgggatcgcctccgtgtccggcgcggtcttcgcgcgcgtggccatgggcacggcgtgcgacctggtgggcccgcgcctggcgtccgcggccatcatactcctcaccacgcccgccgtctactactccgccgtcatcgactccgcctcgtcctacctgctcgtgcgcttcttcacgggcttctcgctcgcgtccttcgtgtccacgcagttctggatgagctccatgttctcgccgcccaaggtggggctggccaacggcgtcgccggggggtggggcaacctcggcggcggcgccgtgcagctcatcatgccgctcgtgttcgaggccatccgcaaggccggggccacgccgttcacggcgtggcgcgtcgccttcttcgtcccgggcctgctgcagacgctgtcggccgtcgccgtgctggcgttcggccaggacatgcccgacggcaactaccgcaagctgcacaggtccggcgacatgcacaaggacagcttcggcaacgtgctccgccacgccgtcaccaactaccgcgcctggatcctggcgctcacctacggatactgcttcggcgtggagctcgccgtggacaacatcgtcgcgcagtacttctacgaccgcttcggcgtcaagctcagcaccgccggcttcatcgccgccagcttcgggatggccaacatcgtctcccgccccggcggcggcctcctgtcggactggctctccagccgcttcggcatgcgcggcaggctgtggggcctgtgggtggtgcagaccatcgggggcgtcctctgcgtcgtgctcggcgccgtcgactactccttcgccgcgtccgtggccgtcatgatactcttctccatgttcgtgcaggcggcctgcgggctcacctttggcatcgtcccgttcgtctcccgaaggtcgctggggctcatctccggcatgaccggcggcggcggcaacgtgggcgccgtgctcacgcagctcatcttcttccacggatccaagtacaagacggagacggggatcaagtacatggggttcatgatcatcgcctgcacgttgcccatcacgctcatctacttcccgcagtggggcggcatgttcctggggccgcggcccggggcgacggcggaggactactacaaccgggagtggacagcgcacgagtgcgacaagggtttcaacaccgcgagcgtacgctttgcggagaacagcgtgcgggaagggggacgctcgggcagccagtccaagcacactactgtgcccgtcgagtcctcgccggccgacgtgtgaaacacacacaagcatacggtactgcccgtataatcagcggtccctcccgtgtcagcaaatcatatgtagtgttcctaagtcgtgatgactccgtacgtgtggtaatttctgtgtgaaggaaaaaccgggggtgaatttccggggggtgaaaaaaaaaaaaaaaaaaaaaaaaaaa

SEQ ID NO: 5508 - protein, 520 aa, Zea mays
  misc_feature: PFam Name: HATPase_c; PFam Description: Histidine kinase-,
  misc_feature: GI Number: 50947327; NR Description: heat shock protein 82 [Oryza sativa (japonica cultivar-group)] >gi|417154|sp|P33126|HS82_ORYSA HEAT SHOCK PROTEIN 82 >gi|100685|pir||S25541 heat shock protein 82 - rice (strain
  misc_feature: GI Number: 39104468; NR Description: heat shock protein 90
  misc_feature: GI Number: 50725877; NR Description: putative heat shock
  misc_feature: GI Number: 50725880; NR Description: putative heat shock
  misc_feature: GI Number: 32765549; NR Description: cytosolic heat shock
MAEGEFKPAAMQVEAPAEAAAAPSKPRFRMPVDSDNKATEFWLFSFARPHMSAFHMSWFSFFCCFLSTFAAPPLLPLIRDTLGLTATDIGNAGIASVSGAVFARVAMGTACDLVGPRLASAAIILLTTPAVYYSAVIDSASSYLLVRFFTGFSLASFVSTQFWMSSMFSPPKVGLANGVAGGWGNLGGGAVQLIMPLVFEAIRKAGATPFTAWRVAFFVPGLLQTLSAVAVLAFGQDMPDGNYRKLHRSGDMHKDSFGNVLRHAVTNYRAWILALTYGYCFGVELAVDNIVAQYFYDRFGVKLSTAGFIAASFGMANIVSRPGGGLLSDWLSSRFGMRGRLWGLWVVQTIGGVLCVVLGAVDYSFAASVAVMILFSMFVQAACGLTFGIVPFVSRRSLGLISGMTGGGGNVGAVLTQLIFFHGSKYKTETGIKYMGFMIIACTLPITLIYFPQWGGMFLGPRPGATAEDYYNREWTAHECDKGFNTASVRFAENSVREGGRSGSQSKHTTVPVESSPADV

SEQ ID NO: 5509 - DNA, 2247 bp, Zea mays
  misc_feature (1)..(2247): Ceres cDNA ID no. 22005847
  misc_feature (1)..(2247): Ceres CLONE  ID no. 1549733
  misc_feature (1)..(2247): Also known as  Ceres CDNA ID no. 24386690
aatgcttcccgccactcctatccatccatctcttccccacgcacacaacaaaagatctcagagccacacagcgagcgcgagcgagaggcgcgctgttgcggaaatgccgctcccggcgttcctggcggcggcggcgaggctcgcggtcctgctggccgccgccgtgactgcggccaacgcggcctccttcgcgcgataccggcgccgccacctccgccgcatccccaaccccatcgacgagtccgccgaccccgtcgccgacttccacgccctccgccccgcctccgccgaggacgccgcagaagatgacagcttcttctttgggctagcgaccgcgccggcacatgtggaggacaggttggaagacgcttggcttcagtttgcggtggagcactcctgcgacgacaaggaggccatgcgcgaccctacgacagcagatgcggtgatggcgtccgctgcaggggacggaggtgctcagttggcttctcgtaggtcgtccagaggggatgatgatagggatggtgatggagagttgaggaagcctcttaagatcgccatggaggcgatgctcagggggtttgaaatgtttgctgagggtggtgagtcaggttctgctgctgctgccggtgacagttgcagccacaacgttgcggcttggcacaatgtcccttgcccgcaagaaaggcttaagttttggtctgatcctgatactgagttgaaacttgctaaggaaactgggatcagtgtcttccgcatggggattgattggacgagggtaatgccgaaggaaccaatcgaaggcctcaagagctcagtcaattttgctgcgctcgagcggtatagatggatcgtccaaagggttcgtgactatggaatgaaagtgatgcttacgctgtttcaccactcgcttccaccttgggccggagaatatggcgggtggaggatggaaaaaactgtcaagtactttctggactttgtgaggcttgttgttgatcgcgtgtcagatttggtggactactgggtggttttcaatgaacctcatgtgtttgtgatgctgacctattgtgccggtgcttggcctggtggtgaccctaatgcaatcgaggtagcgacgtctgctttgccgactggtgtatacaaccaagcattacattggatggctattgcacatgcggaagcctacgattacatacattcaaaaggcgaaagtaaaaggaagccggtcgttggtgtcgctcatcatgtatcatttacacgtccctatggtctgtttgatgttgccgctgtcacactggctaattcattgacccttttcccttacatcgatagcatatgtgacaaattggattttattggcatcaactactatgggcaggaggtgatatcaggccctggcctaaagctcgtggacaatgatgagtacagcgaatctggtcggggtgtttatcctgatgggctgtttcgtattctgattcggtttaacgaacgatacaagagcttgaatatacctttcgtagttactgaaaatggagtttctgatgagactgatctgatccggaaaccatatattctggagcacctgttagccatttatgctgcaatccttatgggtgtgcctgtgcttggttatctattctggacaacgtcagataattgggaatgggcagatggatatggtcctaagtttgggcttgtggctgttgatcgtgctaacaacctagcacggaaacctaggccctcgtactatttgttctctaagattgttacaactgggaaaatcacaagacatgacaggttggcggcttggagggagctgcaacaggcagcgtttcagaagaaaacacgcccgttttttagggcagtagataaacatggccggatgtatgcagggggtctggatcggcctatccagagatcattcatattgcgggattggcgatttggtcattatgaaatggaaggcttgcaggatcctttcagccgctttataacatccattatttcaacaattttgtggaaaaagaagaagattcgttacattgaggatgaggatatttcttattctctttcttgttgatgcttcttactctaggtgttatgtctaagagaatttgaggtcccattttttttttactttcactgtatatggcctgtataaaattgtttgcccttatttttatatgtaagtagcatgattcgtcctctagacaaagtaaatataaagttctagaaagtaaaaaaaaaaaa

SEQ ID NO: 5510 - protein, 2247 aa, Zea mays
  misc_feature: PFam Name: Glyco_hydro_1; PFam Description: Glycosyl
  misc_feature: GI Number: 16930457; NR Description: AT3g06510/F5E6_16
  misc_feature: GI Number: 6685165; NR Description: beta-glucosidase
  misc_feature: GI Number: 21593301; NR Description: beta-glucosidase,
  misc_feature: GI Number: 16649039; NR Description: beta-glucosidase, putative [Arabidopsis thaliana] >gi|22077112|emb|CAD36512.1| putative beta-glycosidase [Arabidopsis thaliana] >gi|25083735|gb|AAN72111.1| beta-glucosidase, putative hydrolase
  misc_feature: GI Number: 12322683; NR Description: beta-glucosidase,
AATGCTTCCCGCCACTCCTATCCATCCATCTCTTCCCCACGCACACAACAAAAGATCTCAGAGCCACACAGCGAGCGCGAGCGAGAGGCGCGCTGTTGCGGAAATGCCGCTCCCGGCGTTCCTGGCGGCGGCGGCGAGGCTCGCGGTCCTGCTGGCCGCCGCCGTGACTGCGGCCAACGCGGCCTCCTTCGCGCGATACCGGCGCCGCCACCTCCGCCGCATCCCCAACCCCATCGACGAGTCCGCCGACCCCGTCGCCGACTTCCACGCCCTCCGCCCCGCCTCCGCCGAGGACGCCGCAGAAGATGACAGCTTCTTCTTTGGGCTAGCGACCGCGCCGGCACATGTGGAGGACAGGTTGGAAGACGCTTGGCTTCAGTTTGCGGTGGAGCACTCCTGCGACGACAAGGAGGCCATGCGCGACCCTACGACAGCAGATGCGGTGATGGCGTCCGCTGCAGGGGACGGAGGTGCTCAGTTGGCTTCTCGTAGGTCGTCCAGAGGGGATGATGATAGGGATGGTGATGGAGAGTTGAGGAAGCCTCTTAAGATCGCCATGGAGGCGATGCTCAGGGGGTTTGAAATGTTTGCTGAGGGTGGTGAGTCAGGTTCTGCTGCTGCTGCCGGTGACAGTTGCAGCCACAACGTTGCGGCTTGGCACAATGTCCCTTGCCCGCAAGAAAGGCTTAAGTTTTGGTCTGATCCTGATACTGAGTTGAAACTTGCTAAGGAAACTGGGATCAGTGTCTTCCGCATGGGGATTGATTGGACGAGGGTAATGCCGAAGGAACCAATCGAAGGCCTCAAGAGCTCAGTCAATTTTGCTGCGCTCGAGCGGTATAGATGGATCGTCCAAAGGGTTCGTGACTATGGAATGAAAGTGATGCTTACGCTGTTTCACCACTCGCTTCCACCTTGGGCCGGAGAATATGGCGGGTGGAGGATGGAAAAAACTGTCAAGTACTTTCTGGACTTTGTGAGGCTTGTTGTTGATCGCGTGTCAGATTTGGTGGACTACTGGGTGGTTTTCAATGAACCTCATGTGTTTGTGATGCTGACCTATTGTGCCGGTGCTTGGCCTGGTGGTGACCCTAATGCAATCGAGGTAGCGACGTCTGCTTTGCCGACTGGTGTATACAACCAAGCATTACATTGGATGGCTATTGCACATGCGGAAGCCTACGATTACATACATTCAAAAGGCGAAAGTAAAAGGAAGCCGGTCGTTGGTGTCGCTCATCATGTATCATTTACACGTCCCTATGGTCTGTTTGATGTTGCCGCTGTCACACTGGCTAATTCATTGACCCTTTTCCCTTACATCGATAGCATATGTGACAAATTGGATTTTATTGGCATCAACTACTATGGGCAGGAGGTGATATCAGGCCCTGGCCTAAAGCTCGTGGACAATGATGAGTACAGCGAATCTGGTCGGGGTGTTTATCCTGATGGGCTGTTTCGTATTCTGATTCGGTTTAACGAACGATACAAGAGCTTGAATATACCTTTCGTAGTTACTGAAAATGGAGTTTCTGATGAGACTGATCTGATCCGGAAACCATATATTCTGGAGCACCTGTTAGCCATTTATGCTGCAATCCTTATGGGTGTGCCTGTGCTTGGTTATCTATTCTGGACAACGTCAGATAATTGGGAATGGGCAGATGGATATGGTCCTAAGTTTGGGCTTGTGGCTGTTGATCGTGCTAACAACCTAGCACGGAAACCTAGGCCCTCGTACTATTTGTTCTCTAAGATTGTTACAACTGGGAAAATCACAAGACATGACAGGTTGGCGGCTTGGAGGGAGCTGCAACAGGCAGCGTTTCAGAAGAAAACACGCCCGTTTTTTAGGGCAGTAGATAAACATGGCCGGATGTATGCAGGGGGTCTGGATCGGCCTATCCAGAGATCATTCATATTGCGGGATTGGCGATTTGGTCATTATGAAATGGAAGGCTTGCAGGATCCTTTCAGCCGCTTTATAACATCCATTATTTCAACAATTTTGTGGAAAAAGAAGAAGATTCGTTACATTGAGGATGAGGATATTTCTTATTCTCTTTCTTGTTGATGCTTCTTACTCTAGGTGTTATGTCTAAGAGAATTTGAGGTCCCATTTTTTTTTTACTTTCACTGTATATGGCCTGTATAAAATTGTTTGCCCTTATTTTTATATGTAAGTAGCATGATTCGTCCTCTAGACAAAGTAAATATAAAGTTCTAGAAAGTAAAAAAAAAAAA

SEQ ID NO: 5511 - DNA, 2039 bp, Zea mays
  misc_feature (1)..(2039): Ceres cDNA ID no. 22005848
  misc_feature (1)..(2039): Ceres CLONE  ID no. 1549948
  misc_feature (1)..(2039): Also known as  Ceres CDNA ID no. 23836850
agttccagactgcctcctccactccagtgtggccgttcgttcccctctgttccgcgccggcgcgccgcccaactctgagcgatggaaggcaccgtgctgtgcgcggccaaccacgcgccgctcacgcccatcagcttcctcgagcgcaccgcgctcgtctaccccgaccgccccgccgtcgtcgccgccggacacgccgccgcgccgccgccgcgcacctggcggcagacccgggaccgctgcctccgcctcgccgcggcgctcgcggggctcggcgtcgcgcgccgtgacgtggttgcggtgttcgcgcagaacatcccggccttctgcgagctccacttcggcattcccatggcgggcgccgtgatctgcgcgctcaactcgcggctcgacgccggcatggcgtccgtgctgctgcagcactcggaggccaaggtcgtgttcgtggacgccgcgctactgggcgtcgcccgggaggcgctccgcctcatctcccagcaggccggcggagcgagcagggtgcccgccgtggtactaatcaacgaggcgctcgacgagccgccgtcagcggcgacaggaaacgacaagatcccaggcgtcgatcggtgctacgagtacgaggccctcctcctcagcagcagcagaggcggcgatccagagttcttgatccggtggccggacgacgagaacgagccgatcgcgctgaactacacgtcggggacgacgtcgcggcccaagggcgtggtgtacacccaccgcggcgcgtacctgaactcgctgtcgtcggtgctcctcaacgacatgacggcgctgccggtgtacctgtggacggtgcccatgttccactgcaacgggtggtgcctggtgtggggcgtggcggcgcagggcggcaccaacgtgtgcctgcgcaaggtgaactcgggcgccatcttcgcggccgtggcggcgcacggggtgacgcacatgggcggcgcgccgacggtgctgagcatggtggtgaacgccacggcggaggagagggcgccgctgggcgcggggaggaagaggccggtgactgtgatgacgggcggcgcgccgccggcgccgcaggtgctgttccggatggaggagctcgggttcctggtgatccactcgtacgggctgacggagacgtacgggccagcgacggtgtgcacgtggcggcccgagtgggacgcgctgccggcggcggagcgcgcggccatcaaggcccggcaggggctccaccacctggggctggaggtggacgtgaaggacccggccacgatggccagcgtgcccgcggacgggcgcaccatgggcgaggtgatgttccgcgggaacacggtgatgggcgggtactacaaggacgcggccgcgacggcggaggccatggccggcgggtggctgcggtcgggcgacctggcggtgcggcacgccggcgacggctacgtgcggatcctggaccggtccaaggacatcatcatctccggcggggagaacatcagcaccatcgaggtggaggcggcgctgttcgcgcacccggccgtggcggaggccgcagtggtggggcggcccgacgagtactggggcgagacgccgtgcgcattcgtgacgctcagggagggcgcggccggcagcgtgcgcgccgaggaggtggtggcgttctgccaggcgcgcctgccgcggtacatggcgccccggacggtggtgttcgtggccgagctgcccaagacagccacggggaaggtgcagaagttcgcgctccgggagcaggccagggccatgggcagcatctccagctccgagcagcaggatggggcagggacgaggagcaagctctgatctgaactcgcatgcccacatggatgtctcctccattccactgacgagtagttgagcagcaacgaacctaagtgtgctgagctgtgctgtgctgtgcttggacatgtagagaaagagaatcaccacactcagtgatacagattcgtcatttcagtaatataatttacagtatcaaccttcaaaaaaaaaaaaaaaaa

SEQ ID NO: 5512 - protein, 586 aa, Zea mays
  misc_feature: PFam Name: AMP-binding; PFam Description: AMP-binding enzyme
  misc_feature: GI Number: 18394877; NR Description: AMP-dependent synthetase
  misc_feature: GI Number: 18700260; NR Description: At1g20560/F2D10_4 [Arabidopsis thaliana] >gi|13937177|gb|AAK50082.1|
  misc_feature: GI Number: 8778599; NR Description: F5M15.12 [Arabidopsis thaliana]
  misc_feature: GI Number: 22758279; NR Description: Putative AMP-binding
  misc_feature: GI Number: 22758280; NR Description: Putative AMP-binding
MEGTVLCAANHAPLTPISFLERTALVYPDRPAVVAAGHAAAPPPRTWRQTRDRCLRLAAALAGLGVARRDVVAVFAQNIPAFCELHFGIPMAGAVICALNSRLDAGMASVLLQHSEAKVVFVDAALLGVAREALRLISQQAGGASRVPAVVLINEALDEPPSAATGNDKIPGVDRCYEYEALLLSSSRGGDPEFLIRWPDDENEPIALNYTSGTTSRPKGVVYTHRGAYLNSLSSVLLNDMTALPVYLWTVPMFHCNGWCLVWGVAAQGGTNVCLRKVNSGAIFAAVAAHGVTHMGGAPTVLSMVVNATAEERAPLGAGRKRPVTVMTGGAPPAPQVLFRMEELGFLVIHSYGLTETYGPATVCTWRPEWDALPAAERAAIKARQGLHHLGLEVDVKDPATMASVPADGRTMGEVMFRGNTVMGGYYKDAAATAEAMAGGWLRSGDLAVRHAGDGYVRILDRSKDIIISGGENISTIEVEAALFAHPAVAEAAVVGRPDEYWGETPCAFVTLREGAAGSVRAEEVVAFCQARLPRYMAPRTVVFVAELPKTATGKVQKFALREQARAMGSISSSEQQDGAGTRSKL

SEQ ID NO: 5513 - DNA, 2169 bp, Zea mays
  misc_feature (1)..(2169): Ceres cDNA ID no. 22005850
  misc_feature (1)..(2169): Ceres CLONE  ID no. 1551029
  misc_feature (1)..(2169): Also known as  Ceres CDNA ID no. 24386373
aatccatctcactagctaagccagcagccacagccacagacatagcaaccacacgctcttcgatccgtcatcagccagcgcgcgcctcgatctccttcgattcaatcgtttgacattgatatggcgttcgctgaggaggagacgacgaggtaccttggcacgaacctcatcgagagctgcggcgactcggaggacgggctcaccggctgggctccgtccggctcgtgcacgctctccgcgcacgccgacgaggacgcgtctcttccttcgctggcagccgcattgtccgccgccgccggcgacgaggactctgacgaggacgaattccagcagcgcgcgccgaggcccagcggccggtacgtcctggccgcgcgccgcgcgagcgacaaggacgggctatgccgcgcggtctcgcgcgcgccgatcaggcccaacgtaacgtaccgggtggccgggtgggtcggcctgggcgccgccgtggagggctcccacgccgttcacgtcgaggtccgcgtcgacggtggtggccgcccggtcggtggcggcgtggctgtggtcgagtcggggaagtggggccagatcaagggctcgttccgtgtcgacggcgatgagccaccgcgccacgccaaggtctacgttcacgggccgccggcaggggtggacctcaaggtcacgggcatgcaggtgtgcgcggtgaacaagattccgaggctgaggcacctcaggaagaaggccgacaaggtgcgcaagcgtgacgtggtcctcaaggtgagccggcggacgggcgtcgacgacgacacgacggcgagcgtcgccggggcgcacatccaggtggtccaggtccagaacagcgtccccatcggcagctgcatcaccaaggcgggcatgcagaacccggagtacgtggacttcttcaccaagcacttcgactgggccgtgctcgagaacgagctcaagtggtactacacggaggccgtgcgggggcaggtgagctacgccgacgccgacgagctcatcggcttctgcgaccgccacggcaagcccgtgcgcgggcactgcatcttctgggccgtggagaactcggtgcagccgtgggtccgcgcgctcagcgccgaccagctccgggcggccgtggaggcccggctgcggggcctcgtgtcgcgctacgcaggccggttcccgcactacgaggtgaacaacgagatgctccacggggcattctaccagcagcgcctcggcgacgacatcaacgcgcacatgttccgggagacggcgcagatcgacccggcgccggcgctgttcgtgaacgactacaacgtggagagcgccaacgaccccagcgccacgccggagaagtacgtggcgctggtcacggacctgcagaggcggggcgcgcccgtgggcgggatcggcgtccagggccacgtcacgcaccccgtcggggacatcatctgcgacgcgctggacaagctcgccgtcacggggctgcccatctggatcacggagctggacgtgtcggccgccgacgagtccgtgcgcgccgacgacctggagatcgttctgcgggaggcgttcgcgcacccggccgtcgagggcatcatgctctggggcttcatgcagggccacatgtggcgctcccacggccagctcgtcaacgccgacggcaagtacacccaggccggcaacatgttcgcgggcctccgccaggagtggacgtcgcacgcgcgggggaaggtggacagcaacggcaacttcaagttcagagggttccacggcacttaccaggtgctgcttacgacgcccgccggagaggtgaagaagcggacgttcgacgtacacaagggggatgcgccgctcgtgctggacatggatttctagcttttcagtacatcgtacacattggtcacccaccggttattacagttacgacaaggattattagtacgatctagaacttatatatttgtgtacaaattaagtgtggtatattgggattggtgtgatgcttagaaatatatagtagtgaagaaaaaataagaatctttagtcccggattgtgtagatgattggtactattgtactcggtatttattatgacagactgcagtaaataaacaaaaggattaccttttttccaccttggtttgtttataaaaaaaaaaaaaaaaa

SEQ ID NO: 5514 - protein, 585 aa, Zea mays
  misc_feature: PFam Name: Glyco_hydro_10; PFam Description: Glycosyl
  misc_feature: PFam Name: CBM_4_9; PFam Description: Carbohydrate binding domain
  misc_feature: PFam Name: Peptidase_S8; PFam Description: Subtilase family
  misc_feature: PFam Name: HlyD; PFam Description: HlyD family secretion protein
  misc_feature: PFam Name: Transferase; PFam Description: Transferase family
  misc_feature: GI Number: 14861193; NR Description: 1,4-beta-D xylan
  misc_feature: GI Number: 14861209; NR Description: 1,4-beta-D xylan
  misc_feature: GI Number: 14861199; NR Description: 1,4-beta-D xylan xylanohydrolase [Hordeum vulgare] >gi|14861195|gb|AAK73560.1|
  misc_feature: GI Number: 42566329; NR Description: glycosyl hydrolase family 10 protein / carbohydrate-binding domain-containing protein
  misc_feature: GI Number: 50936843; NR Description: putative 1,4-beta-D xylan xylanohydrolase [Oryza sativa (japonica cultivar-group)] >gi|38175736|dbj|BAC57375.2| putative 1,4-beta-D xylan
MAFAEEETTRYLGTNLIESCGDSEDGLTGWAPSGSCTLSAHADEDASLPSLAAALSAAAGDEDSDEDEFQQRAPRPSGRYVLAARRASDKDGLCRAVSRAPIRPNVTYRVAGWVGLGAAVEGSHAVHVEVRVDGGGRPVGGGVAVVESGKWGQIKGSFRVDGDEPPRHAKVYVHGPPAGVDLKVTGMQVCAVNKIPRLRHLRKKADKVRKRDVVLKVSRRTGVDDDTTASVAGAHIQVVQVQNSVPIGSCITKAGMQNPEYVDFFTKHFDWAVLENELKWYYTEAVRGQVSYADADELIGFCDRHGKPVRGHCIFWAVENSVQPWVRALSADQLRAAVEARLRGLVSRYAGRFPHYEVNNEMLHGAFYQQRLGDDINAHMFRETAQIDPAPALFVNDYNVESANDPSATPEKYVALVTDLQRRGAPVGGIGVQGHVTHPVGDIICDALDKLAVTGLPIWITELDVSAADESVRADDLEIVLREAFAHPAVEGIMLWGFMQGHMWRSHGQLVNADGKYTQAGNMFAGLRQEWTSHARGKVDSNGNFKFRGFHGTYQVLLTTPAGEVKKRTFDVHKGDAPLVLDMDF

SEQ ID NO: 5515 - DNA, 2263 bp, Zea mays
  misc_feature (1)..(2263): Ceres cDNA ID no. 22005851
  misc_feature (1)..(2263): Ceres CLONE  ID no. 1552233
  misc_feature (1)..(2263): Also known as  Ceres CDNA ID no. 24387579
aaagggaatccgatcaatcccggactcgtcctcccggccaaccctagcttcccttctcttcccctcccccgatggacccgccgccaaccagggacagaggggaggagctggagcctgaaacccgcgccttccccgacgccgacgacccggagacctcccgatctgaacgcgaagagggtatccctccaccgccaccgccaccgcctctgcgccagcagctcatgggggcttgccgcgccgacgagcgcctcaggccgctcctcaccctcaacgtctcctgcggcgcagcggacgaccgactcatcgcacacctcgcgcagcacttcgaggtgtcggaggtgggcatgctcgcgcgttgcctctgtgttcccctcgtttccctgcgcgttggcaaggttcagagggaaggggccctcctctgcccaacacacattaggtaatttgggcgtttgtcataatctctgatatatgaggaaagagaagagggaagctgaaccttgttcttctgccatcatctagcatgcggcttacctttgtttgtgatgatggttatccagagcaactagctctcttgagcaatggctttgaattttcggaagttatgattgaagaaatatcagctgataattctggacgctctttcctaatcagaatttcagaatctaaagtgttttactactggtgtgctgagaagtcgaaggaacatggaatggaacttcttgcaaagatgaaaaaccttttggacgggaggccaacactctctgatctcactggcatctctaattcacgacttgatgcttttgccactcatttacatgcttatcttcttgcatcaagtatcggtgatgttacatcattgggctcacttaatgacttcctgagtacttcaagatcacatgatcaatatttacagctccagtcagatttttccaaaacttccaggttccgtgcctcggctgctagtgcaattaagccaagctctgtctatcaagccagcctaagtccgagatctggcacttttaaagatggggtaccaagggcttcatgtgcaagggttgttgggagggacaagctgaagcgtcgtgtggaatggttaggcccgttaactgctccgcttgatacgaatcctttgacaatcaaccctgattctgccagtgagaagtgtgatgcagattgttcaaagaacaatgttagctcagttccgttggacctgcctctttcgtttcccctgttgccttctatttactcccttggcactcgtccggttcctgaggtttctttggagaaacagtttaagccttactattgctggtgcccaccatgcccatcatcgctgcaatacactgtcacccatttgcatctgccagctacacctgtagatccgttgcccctaccacctttgagttcactgctagcaagtgagcagccaccttcttcaacagtttctgtaaagctggatacaactgatctcccttcccttaatcttccgtccatactgcattcaccacttattcccctacatggtccacaagtgccaacattcacaccattgatgtccgatcccattgtgcatgtcccagtcattgatgtttgttcggcgggtcaggcctatctagtgagttgtgggccgtctataacttcagcagttcccctgctcccgagcttgaagcctctgctgccagaagcagagtcgttagtcgagagaagcgcaagggaaacactgatgaggctcatagcttcgacaccacctgcaagcaatcctctacctggaagtatatcctgggcgaataacaatgtgaagaagcatgttgatgtgtgtcccaatgaaaaagcatccggtacgtcttgtgttgctgctgtgtttggaagtgggattgcacacgctgaggatgaagttccaagcggaggtgattcacaagagccgtttgccgaatacgatggtaccagcaatgaatgtgatgtacatcattggcagaaattctagcttggctgcatcagcatggtaaatagggttttgaggattcgggggtttgatgtcctgtacgcagcagcagccttaaaagtttctgtgcccagccagcatctctatttggtttgcaaatgtaattactagtttgtactgtcttgtttttggcaaacttgctgcgagcctcgtgcttagtttggtttatttatttatgaactttaggcctgttcgaagcacccagtttgtaagaaaatggattatataaactgaagtgattcctaaaaaaaaaaaaaaaaa

SEQ ID NO: 5516 - protein, 487 aa, Zea mays
MRLTFVCDDGYPEQLALLSNGFEFSEVMIEEISADNSGRSFLIRISESKVFYYWCAEKSKEHGMELLAKMKNLLDGRPTLSDLTGISNSRLDAFATHLHAYLLASSIGDVTSLGSLNDFLSTSRSHDQYLQLQSDFSKTSRFRASAASAIKPSSVYQASLSPRSGTFKDGVPRASCARVVGRDKLKRRVEWLGPLTAPLDTNPLTINPDSASEKCDADCSKNNVSSVPLDLPLSFPLLPSIYSLGTRPVPEVSLEKQFKPYYCWCPPCPSSLQYTVTHLHLPATPVDPLPLPPLSSLLASEQPPSSTVSVKLDTTDLPSLNLPSILHSPLIPLHGPQVPTFTPLMSDPIVHVPVIDVCSAGQAYLVSCGPSITSAVPLLPSLKPLLPEAESLVERSARETLMRLIASTPPASNPLPGSISWANNNVKKHVDVCPNEKASGTSCVAAVFGSGIAHAEDEVPSGGDSQEPFAEYDGTSNECDVHHWQKF

SEQ ID NO: 5517 - DNA, 1575 bp, Zea mays
  misc_feature (1)..(1575): Ceres cDNA ID no. 22005852
  misc_feature (1)..(1575): Ceres CLONE  ID no. 1553764
  misc_feature (1)..(1575): Also known as  Ceres CDNA ID no. 24392208
aaggccgggctaaatcgtcgagagccaattcagcgaagccccgaaccctccctccctcccatggccgtccgccgcaggaccgcggcggccgctgccggggacccgcctccgcaggcgccaccggcagatgaggcggcggcggtggcaccagacgaaccggtcctccgggcgccgaacctgcgcgtggccgctgtggcagcggcgctcttcctcgcgcccttctcgtacctcgcgttcgtgcactactccctgaccgccgatctgcagcgatccatcctcaaatgcggcgccatgagcctcgttgggttctgcgtcgcgctgaagctcatccctatcgcggcccgctaccacctccgccgccgtatgttcggctacgacatcaacaagaaaggcttgcctacgggtcaaatcaaagtgcctgaggcactaggccttgttgtggggattgtctatttggtcattgctattatatttcagcagtttcactatgccccagactccatttggcttgttgaatataatgcagcattgacatccgtctgctttatgattcttcttggatttgttgatgatgttcttgatgttccatggagagtgaaattggcgctgccaacatttgcagcactcccattgttgatggcatatgctggtggcacttccatcatcattccaaagcctttaaccccttatgttgggctaacagttttggagctaggtttattttacaagctattcatgctcttgttagcagtcttttgtacaaactcgataaatatacatgctggcctaaatggacttgaagttgggcagacagttgttatatctgcggcggttttgatacataatgtaatgcgcatagcatcttctacagatattgaaactcagcaagctcatgaattctctatttatcttgtcttgccattcctaaccatttcattagctctgctagcttttaactggtatccttcaattgtttttgttggtgatacctacacctattttgctggaatggctttggctgtgataggaattttgggacatttcagcgagacgttgttgctcttctttttacctcaagttcttaatttcctgtgttcggtcccacagctctttcactttgttccttgcccaagacataggttgccgaggtttgatcctggagcgggtctgttgactggtaccaaagatgggaatctggttaacatattccttaggttatttggaaagtgctcagagagggccctttgcataaggctccttattttccaggctctatgttgcgtattctgcttctggctaaggtacatgctcaccggatggtacaagtgataacctgcaatcggctctccatcctgacacccagctcgttgggaaaaaaaatcagctgcatctgatggctgttgttttcctcgacatacttgtagactaaccagagtaggtttttggattcatttcctatgtatacttgtgctaactacagtttccaagtctttgtaaccatatatatgcaatgcctttggcttcaaggaagtcttcggtatacttgtgtaccaaaaaaaaaaaaaaaaaaaaaaa

SEQ ID NO: 5518 - protein, 422 aa, Zea mays
  misc_feature: PFam Name: Glycos_transf_4; PFam Description: Glycosyl transferase
  misc_feature: GI Number: 21618187; NR Description: UDP-GlcNAc:dolichol phosphate N-acetylglucosamine-1-phosphate transferase-like protein [Arabidopsis thaliana] >gi|6735301|emb|CAB68128.1| UDP-GlcNAc:dolichol phosphate N-acetylglucosamine-1-phosphate
  misc_feature: GI Number: 50939775; NR Description: putative UDP-GlcNAc:dolichol phosphate N-acetylglucosamine-1-phosphate transferase [Oryza sativa (japonica cultivar-group)] >gi|34395184|dbj|BAC83573.1| putative UDP-GlcNAc:dolichol phosphate
  misc_feature: GI Number: 21536770; NR Description: putative UDP-N-acetylglucosamine-dolichyl-phosphate
  misc_feature: GI Number: 7450080; NR Description: UDP-N-acetylglucosamine-dolichyl-phosphate-N-acetylglucosami
  misc_feature: GI Number: 60463913; NR Description: UDP-N-acetylglucosamine-dolichyl-phosphate
MAVRRRTAAAAAGDPPPQAPPADEAAAVAPDEPVLRAPNLRVAAVAAALFLAPFSYLAFVHYSLTADLQRSILKCGAMSLVGFCVALKLIPIAARYHLRRRMFGYDINKKGLPTGQIKVPEALGLVVGIVYLVIAIIFQQFHYAPDSIWLVEYNAALTSVCFMILLGFVDDVLDVPWRVKLALPTFAALPLLMAYAGGTSIIIPKPLTPYVGLTVLELGLFYKLFMLLLAVFCTNSINIHAGLNGLEVGQTVVISAAVLIHNVMRIASSTDIETQQAHEFSIYLVLPFLTISLALLAFNWYPSIVFVGDTYTYFAGMALAVIGILGHFSETLLLFFLPQVLNFLCSVPQLFHFVPCPRHRLPRFDPGAGLLTGTKDGNLVNIFLRLFGKCSERALCIRLLIFQALCCVFCFWLRYMLTGWYK

SEQ ID NO: 5519 - DNA, 1622 bp, Zea mays
  misc_feature (1)..(1622): Ceres cDNA ID no. 22005853
  misc_feature (1)..(1622): Ceres CLONE  ID no. 1278638
  misc_feature (1)..(1622): Also known as  Ceres CDNA ID no. 24396703
atagaaaacactagtactgtcccctcccggacatcagagacagacacagtagagacgaggcagaggcttctagatctactgccagctcggcagcaacaaagccgaagcgtctcgcgtgcgcggccgccaccggggattagggatggcggcgaagaaggtgctcatgctctgcggcgactacatggaggactacgaggtcatggtcccgttccaagcgctgcaagcgtatggggtgtccgtggacgccgtctgccctagcaagaaggccggcgacatctgccgcaccgccgtccatcagctgaccggtcaccagacatactctgagacaaaaggccataatttcacactgaatgcttcatttgatgagattactgctagtgaatatgatggattggtaattcctggagggcgtgcaccagaataccttgcgatggatgaaaaggtgcttgacctagtcagaatgttctctggtgctaagaagcctattgcatcagtttgtcatggacagttgattttagcggcagcaagagtagtcgagaaccgtacctgcacagcatttccggctgttaaaccagttttggttgctgctggtgccaagtgggaagagcctgacacaatggcaaaatgcactgttgatggcaatctcatcacagcagcgacttataattctcatcccgaattcatcagcctatttgtcaaagcactcggaggttcagtggcaggctcagataagagaatactgttcctatgtggggactacatggaggattatgaggtcatggtcccattccaggctctccaagctcttggctgccatgtcgatgccgtttgccccgacaagggagctggggagacgtgcccgacagccattcatgatttcgaaggtgaccagacctacagcgagaagcctggccacgattttactctgacagcgtcgtttggaagtgtggatgcttcgagctacgacgcgcttgtggttcctggcggacgggctccagagtacctggctctgaacgataaggtcatcagcttggtgaaggccttcgcggagagcggaaagccaatcgcgtcgatctgccacggccagcagatattatccgctgccggagtcctcaaggggaagaagtgcaccgcatacccagccgtgaagctgaacgtgttgctcggtggcgggacctggctggagcctgacccgatccaccgctgcttcaccgatggcaaccttgtgaccggcgcagcctggccaggccacccagagttcgtgtcccagctcatggcgttgctcggcgtcaaggtttccttctgaagtccaaactgaaagggcaaggcagaaagagctctggctcaacctggggaggggcgtgatagcatagctttggatttccagatagaagagaacagactcaaaacgacaccttatagcgatcgctgcacttaatccttgttccatgcgcagcaagcctcaggcttattacccttgtttgtcagcgttgtgtaaaaactgtaacccggatgctgtttcttcttcttcttcttggttccttcttttttctgagtcgtcctttgtagattcaaataataaataaagtcttgtatactgctgtttgttgaaaaaaaaaaaa

SEQ ID NO: 5520 - protein, 387 aa, Zea mays
  misc_feature: PFam Name: DJ-1_PfpI; PFam Description: DJ-1/PfpI family
  misc_feature: GI Number: 46579408; NR Description: ThiJ/PfpI family protein [Desulfovibrio vulgaris subsp. vulgaris str. Hildenborough] >gi|46448822|gb|AAS95475.1| ThiJ/PfpI family protein [Desulfovibrio
  misc_feature: GI Number: 48858772; NR Description: COG0693: Putative intracellular protease/amidase [Clostridium thermocellum ATCC
  misc_feature: GI Number: 17987076; NR Description: PROTEASE I [Brucella melitensis 16M] >gi|25322940|pir||AC3351 proteinase I (EC 3.4.-.-) [imported] - Brucella melitensis (strain 16M)
  misc_feature: GI Number: 23502074; NR Description: ThiJ/PfpI family protein [Brucella suis 1330] >gi|23348032|gb|AAN30116.1| ThiJ/PfpI family
  misc_feature: GI Number: 23475025; NR Description: COG0693: Putative
MAAKKVLMLCGDYMEDYEVMVPFQALQAYGVSVDAVCPSKKAGDICRTAVHQLTGHQTYSETKGHNFTLNASFDEITASEYDGLVIPGGRAPEYLAMDEKVLDLVRMFSGAKKPIASVCHGQLILAAARVVENRTCTAFPAVKPVLVAAGAKWEEPDTMAKCTVDGNLITAATYNSHPEFISLFVKALGGSVAGSDKRILFLCGDYMEDYEVMVPFQALQALGCHVDAVCPDKGAGETCPTAIHDFEGDQTYSEKPGHDFTLTASFGSVDASSYDALVVPGGRAPEYLALNDKVISLVKAFAESGKPIASICHGQQILSAAGVLKGKKCTAYPAVKLNVLLGGGTWLEPDPIHRCFTDGNLVTGAAWPGHPEFVSQLMALLGVKVSF

SEQ ID NO: 5521 - DNA, 683 bp, Zea mays
  misc_feature (1)..(683): Ceres cDNA ID no. 22005854
  misc_feature (1)..(683): Ceres CLONE  ID no. 1282223
  misc_feature (1)..(683): Also known as  Ceres CDNA ID no. 23834936
acccctacccgcgacttcgctcagcttccgccgatcggcttgccccgtcgatttcgccaacccctcgacccgatcggctccattgatcgtacctcgtcgtccggttgtcgatggccaggacctctttcaaaatggagcacgacctcgagaaaaggcagtccgaatctgccaggatcagggataagtatcccgacagaattcctgtgattgttgagaaagctggcaaaactgatgtccccgagattgataagaagaagtaccttgtccctgctgatctcactgtcggccagtttgtctatgtggtgaggaagagaatcaagctgagcccagagaaggccatctttgtctttgtgaagaacaccttgccaccaactgcctctttgatgtctgcaatctacgaagagaacaaggacgaggatggcttcctttacatgacctacagtggtgaaaacaccttcggctctgcctagagcaatcgcccctgccactgtaaataaacgagcatgatggggctgctgctattgtaaacctgtgtatatacctcagtctctagtatgctgctgccggattgcttcaatggcttcaatgacacccttagctttcaactgtttggatttctcctgtgacattgaattccttcggtatcgaaacatttgatcatttcactaaaaaaaaaaaaaaaa

SEQ ID NO: 5522 - protein, 119 aa, Zea mays
  misc_feature: PFam Name: MAP1_LC3; PFam Description: Microtubule
  misc_feature: GI Number: 50937683; NR Description: putative microtubule associated protein [Oryza sativa (japonica cultivar-group)] >gi|50508631|dbj|BAD31027.1| putative microtubule associated protein [Oryza sativa (japonica cultivar-group)] protein [Oryza
  misc_feature: GI Number: 32401365; NR Description: autophagy [Triticum aestivum]
  misc_feature: GI Number: 37776903; NR Description: putative
  misc_feature: GI Number: 34595981; NR Description: microtubule-associated
  misc_feature: GI Number: 30102824; NR Description: At4g21980 [Arabidopsis thaliana] >gi|21636956|gb|AAM70188.1| autophagy APG8 [Arabidopsis thaliana] >gi|25083028|gb|AAN72035.1| symbiosis-related like
MARTSFKMEHDLEKRQSESARIRDKYPDRIPVIVEKAGKTDVPEIDKKKYLVPADLTVGQFVYVVRKRIKLSPEKAIFVFVKNTLPPTASLMSAIYEENKDEDGFLYMTYSGENTFGSA

SEQ ID NO: 5523 - DNA, 572 bp, Glycine max
  misc_feature (1)..(572): Ceres cDNA ID no. 22005855
  misc_feature (1)..(572): Ceres CLONE  ID no. 1246077
  misc_feature (1)..(572): Also known as  Ceres CDNA ID no. 24403415
agaatttttggtttcacctccttccaagccatgaattttaggagcctggaagatttctgggccttctacatgaaccagcactccaaggcttccacaaggcgctggcacttcgcaggaacactcttcagcattctctttttcttttgttccctcttgttcagttggtggttcttgctccttgtccctttctctgggtatggatgtgccttctatagccacttgtttgtagagaggaatttccctgagactttgagacaccccttttggtccctcatgtgtgacttcaagatgttcgggttcatgctcactggcaacatggatagggagatcaaaaggcttgggaagagacctgtgctgcaagtgttttgatttttgtataagcttttggtgattattattgttattattattattttgaataaacattgaaactggattttttaatgtatttttttagaattttttttaattgctttaataagttatttgggtgtgtgtggatgattttgctgtatattgtggctgaatggacccaatatgtgtgtgatgatgctgcaaaaaaaaaaaaaaaa

SEQ ID NO: 5524 - protein, 572 aa, Glycine max
  misc_feature: GI Number: 32038289; NR Description: COG4323: Predicted
  misc_feature: GI Number: 48729636; NR Description: COG4323: Predicted
  misc_feature: GI Number: 49079944; NR Description: PA3216 [synthetic construct]
  misc_feature: GI Number: 46187561; NR Description: COG4323: Predicted
  misc_feature: GI Number: 31195801; NR Description: ENSANGP00000000102 [Anopheles gambiae] >gi|21289796|gb|EAA01941.1| ENSANGP00000000102
AGAATTTTTGGTTTCACCTCCTTCCAAGCCATGAATTTTAGGAGCCTGGAAGATTTCTGGGCCTTCTACATGAACCAGCACTCCAAGGCTTCCACAAGGCGCTGGCACTTCGCAGGAACACTCTTCAGCATTCTCTTTTTCTTTTGTTCCCTCTTGTTCAGTTGGTGGTTCTTGCTCCTTGTCCCTTTCTCTGGGTATGGATGTGCCTTCTATAGCCACTTGTTTGTAGAGAGGAATTTCCCTGAGACTTTGAGACACCCCTTTTGGTCCCTCATGTGTGACTTCAAGATGTTCGGGTTCATGCTCACTGGCAACATGGATAGGGAGATCAAAAGGCTTGGGAAGAGACCTGTGCTGCAAGTGTTTTGATTTTTGTATAAGCTTTTGGTGATTATTATTGTTATTATTATTATTTTGAATAAACATTGAAACTGGATTTTTTAATGTATTTTTTTAGAATTTTTTTTAATTGCTTTAATAAGTTATTTGGGTGTGTGTGGATGATTTTGCTGTATATTGTGGCTGAATGGACCCAATATGTGTGTGATGATGCTGCAAAAAAAAAAAAAAAA

SEQ ID NO: 5525 - DNA, 1155 bp, Zea mays
  misc_feature (1)..(1155): Ceres cDNA ID no. 22005856
  misc_feature (1)..(1155): Ceres CLONE  ID no. 1556737
  misc_feature (1)..(1155): Also known as  Ceres CDNA ID no. 24381806
acacacaccttggcacctcgccctcgcctccagctccgcacgtcccgtcgcccgcttccacctccacgcgacgcgacggctcgccttcacctcctcgccgccagacgcgcccgccgccacccagcgagccggcagccgcccgctatcccaggcttcgttttcttgttggctccgccactgtgacagatggctgcggggggcgggcggtgcttgctcgccttggcgctcgccgccgcttggatctccggcgcggtggtcgccgcctcatcgtcgggtgagcaggaaggcggaagccgcacacccgtcaaatgcatgccctgctctagaacgtacattggtggtgcacatctggacaccttgacgggccagcttgctcagcgtcgtgacatagtggaaatgtctgattctggtgaattgtgcaaaggacttgctgatgatgtcgaagttcctatgctttcaaaactacgccggcaactggttggtaaaggttctcaccgccgtttagtctattctgtggattttggtgcccatgaaggtgctatggttaatttccttgatcactacgatgcccatctggtgatatttgaaaaacttcctgatggagtgtttgccgacccatttgagctacagcattttgttgagcgcaaagttttcgttgatgttgctgtttttggagacgccaaccttgaactgcccacagctctatccaatgggtcatctgttgagatccattttgatctcaggcgaatcatttcaatcaactgtaaccttgtaatagagatgcctctccatgctagatacccgcctcttgatgccagtggctatgccacagtggagtttggtagcgcagatctattcctccgctacagaaaaaaggacatccattctggttcctgtctttgggtgatcaataatctcaaagctgcacccctggagaaagctgcatggcgcataccctgtggagacgaggcccacataggatttgtatctagcatcacgtttctttcagctcttgtttgctccatgtccattgtcttggcttctctcattttttgacgtcttagggtcctatcagaccttttttttgtttacataaatactgaagtgcgagacaggagaattctcttcatgcatccacaaaaaaaaaaaaaaaaa

SEQ ID NO: 5526 - protein, 289 aa, Zea mays
MAAGGGRCLLALALAAAWISGAVVAASSSGEQEGGSRTPVKCMPCSRTYIGGAHLDTLTGQLAQRRDIVEMSDSGELCKGLADDVEVPMLSKLRRQLVGKGSHRRLVYSVDFGAHEGAMVNFLDHYDAHLVIFEKLPDGVFADPFELQHFVERKVFVDVAVFGDANLELPTALSNGSSVEIHFDLRRIISINCNLVIEMPLHARYPPLDASGYATVEFGSADLFLRYRKKDIHSGSCLWVINNLKAAPLEKAAWRIPCGDEAHIGFVSSITFLSALVCSMSIVLASLIF

SEQ ID NO: 5527 - DNA, 1321 bp, Zea mays
  misc_feature (1)..(1321): Ceres cDNA ID no. 22005858
  misc_feature (1)..(1321): Ceres CLONE  ID no. 1558951
  misc_feature (1)..(1321): Also known as  Ceres CDNA ID no. 24392509
aggactcgccttccccttccgccgcggctccccatctgctccccgatttctcgatacacaccgaaattcgaatcgcccgcctgccgagccctcgcccccacaccgccgatgccctccaagcggccttccccgcacgccatggacgaagccgtctccgcctccgctgccgccgcgcgcctccgcgcctccaccccgcgctccaagaaacgcacctcccgctccaagtcccgcggccgctcccaggatcgccgccgctccccgaaccctaaccctagctcccgtcgcgagcgcgccgcggaccacggctccgccgcgccctcgcgcaagagcgaccgcaagcagaaccgctccttcccggattctgccacgctcgccacggccatggcctcggtcgccgccgcctcggccccgtcgtccggcggggggcgtggtagtgcgggcgccgtccagaagctctggagcgaggtcgatgaggtcgcgctgctcacgggcgctgccgccttcaaggaccgcactggcatcgcgccgcgcctcccggacatgggcgaactgttcgagtccatcaggggctccctcgcgccgcacctcgatcaggccaaggtgtactacaagctcaagcgtctcaagagcaagttccagcactccgtgctgggcgactccagtaccgcgcacgagcaccggctgcgcgacctgggcgcagccctctggggcgccgagctcacgcgccctgaagagaacgccgtcgtgacggctgaggagaccaccgatcccgatgagggattcattgacgaagatagggaggggtccgtgaagcttcctatggttaaggaggtgcttggagagtactggaggttgaacgggcagaccatgtcaggtgtgtcactggagaaggggttggtgctacttgggtcgcagcaagctagtgtggttgaggttaaatggaggcgacagcttgaggcagatatgcgcatgcagatgcgccgacatgatctggaaaaggaggtctatggcctactcatcgatgccatcaaaggcctagggccttagcttggatgcggttgatggagtacatagctggatacataggtgggatgttattttgtaggctgatcaacccgacccgacctcgtggttgctaactgacagacctaacacggcgtgaaggggattgtgggggtttgcacgattcagtcgtgtcaatttatgtctagttgttgaactattcaatatgattgtcaaactcgcttaggtctggagatgtttatttaactaatctatctgagaagaaagctttgcctatgatcaaaaaaaaaaaaaaaaa

SEQ ID NO: 5528 - protein, 312 aa, Zea mays
  misc_feature: PFam Name: FH2; PFam Description: Formin Homology 2 Domain
  misc_feature: PFam Name: Pyr_redox_2; PFam Description: Pyridine
  misc_feature: PFam Name: Extensin_2; PFam Description: Extensin-like region
  misc_feature: PFam Name: LMBR1; PFam Description: LMBR1-like membrane protein
  misc_feature: PFam Name: GATase_2; PFam Description: Glutamine
  misc_feature: GI Number: 535586; NR Description: proline rich protein [Medicago sativa] >gi|1084362|pir||S53504 extensin-like protein S3
  misc_feature: GI Number: 6523547; NR Description: hydroxyproline-rich
  misc_feature: GI Number: 34894166; NR Description: P0439B06.4 [Oryza sativa
  misc_feature: GI Number: 41400381; NR Description: minus agglutinin
  misc_feature: GI Number: 7441828; NR Description: extensin-like cell wall protein - sea-island cotton >gi|451544|gb|AAA79364.1| proline-rich
MPSKRPSPHAMDEAVSASAAAARLRASTPRSKKRTSRSKSRGRSQDRRRSPNPNPSSRRERAADHGSAAPSRKSDRKQNRSFPDSATLATAMASVAAASAPSSGGGRGSAGAVQKLWSEVDEVALLTGAAAFKDRTGIAPRLPDMGELFESIRGSLAPHLDQAKVYYKLKRLKSKFQHSVLGDSSTAHEHRLRDLGAALWGAELTRPEENAVVTAEETTDPDEGFIDEDREGSVKLPMVKEVLGEYWRLNGQTMSGVSLEKGLVLLGSQQASVVEVKWRRQLEADMRMQMRRHDLEKEVYGLLIDAIKGLGP

SEQ ID NO: 5529 - DNA, 1016 bp, Zea mays
  misc_feature (1)..(1016): Ceres cDNA ID no. 22005859
  misc_feature (1)..(1016): Ceres CLONE  ID no. 1559671
  misc_feature (1)..(1016): Also known as  Ceres CDNA ID no. 24362537
atgagagcgtggtgggatcttactgtaaagttccctttgatgctcttttcatcctagaaacataaacaatcctaaggatgaaagtacttaaatcgggacttgggctaggaacaggtgatgttctacccaggttagttaaggattggatgcgtatgtaggcctgttgatcaaggactatcttaactagccacatgccctggaaatgggacagggtaagcttgaacccggctattccatacatgaaaagacaatcgcgcactgggagtggagagatggcgagagtggcacgtaccctcctggcaaaggatcgcctaaaaggggtggtgtgctctcgggtggcgtggacctgttcatgtagtggaggatccgtgggaacggttgacatatgcaagggttaagtgctacatatgtcgtgtggttagagatcctcggctgagtaaatcgattcggatcgccgttatatccccggagagtggagacttgatctccgacctacaacctaagtcaggatgtaaacattatgaataaaaatgatgttgtattgatgagatggtgaaattagaccagatgcaaatagagtctattaatatttaatctggcgttaaaatattgaaagtaaggactcactttagtaagctatttctgcaaaagtatctaagttgattcttgctaaagcctctccttgattcccaaatccagcatatccttgagagtcttttctttagtcgggtaagtcttgctgagtaattccatactcagggttttattccctgttgtttttcaggttatagttttgtgctgatgttgatggtgttaagtgccggtgggctcggccttcttatataagtataccccatctttatcttcttattgaggatggtcacttgagctagcatatattttaaacttataaataatttataacagtttaaagttatttctttgaatcacctttgtaatcaccccggtcatgtacaatgtaaaatttttgtaacctgtaaaaaaaaaaaaaaaaa

SEQ ID NO: 5530 - protein, 68 aa, Zea mays
MPWKWDRVSLNPAIPYMKRQSRTGSGEMARVARTLLAKDRLKGVVCSRVAWTCSCSGGSVGTVDICKG

SEQ ID NO: 5531 - DNA, 944 bp, Zea mays
  misc_feature (1)..(944): Ceres cDNA ID no. 22005861
  misc_feature (1)..(944): Ceres CLONE  ID no. 1561356
  misc_feature (1)..(944): Also known as  Ceres CDNA ID no. 24391200
aagatgccgccttcatttgaagctcccaaagcccaacacctctcctagcctccttccgtcccgccgccactcccgtcatgggcgattccgcggcgggcgcgccggagccgagcaggttcggcaggatctgcgtcttctgcggcagcaaccccggcaatcgcgccgtctacggggacgcagcgctcgacctcggcaaagagctggtggcgaaggggatcgatttggtctacggcggcgggagcgtcgggctcatgggcctgatcgcgcagacggtccttggtggcggctgcagtgtcctcggagtgattccgagagcactcatgccgcttgaggtgtgtattaaaattattaactgtccttttcttctgttctcttctttgtgtgtaccattggtaattctactagttattactctgctctagcggctaactggttcacatttcacaagagagaattataatatctagctaactgcgaaacaactctcagctaaaaactagaatctggctcgcctttggttttgcacctgcttacagctgttccatttgaaatctatccatgaattctgccctggatgttggtttcacatgatcttgctctagtatgtagcagctcacgtagtcctatgtcagtagtgctctccaggtcaccatttgattcctaaggtttgttggctcagattgattcgcctttgcttctgggggttagcaataggtgagtaggtcatcactaaggaattgaaactagggcttcggggaggtgaattgcagactgccaatttagattttagggcgacacaacttggatcaacttgccaatagggcttcggggaggtgaattcctaatgtttaccactgggtgggtttaattataagaatgtgcaacttgccaataggacatctcaacttgagggggaaatagtgtgagaaaaaaaaaaaaaaaaa

SEQ ID NO: 5532 - protein, 114 aa, Zea mays
  misc_feature: PFam Name: Lysine_decarbox; PFam Description: Possible
  misc_feature: GI Number: 34910450; NR Description: lysine decarboxylase-like protein [Oryza sativa (japonica cultivar-group)] >gi|20804658|dbj|BAB92347.1| lysine decarboxylase-like protein
  misc_feature: GI Number: 50932563; NR Description: putative lysine
  misc_feature: GI Number: 34912202; NR Description: P0415C01.3 [Oryza sativa
  misc_feature: GI Number: 53792247; NR Description: lysine
  misc_feature: GI Number: 7573362; NR Description: lysine decarboxylase-like protein [Arabidopsis thaliana] >gi|11358493|pir||T48554 lysine
MGDSAAGAPEPSRFGRICVFCGSNPGNRAVYGDAALDLGKELVAKGIDLVYGGGSVGLMGLIAQTVLGGGCSVLGVIPRALMPLEVCIKIINCPFLLFSSLCVPLVILLVITLL

SEQ ID NO: 5533 - DNA, 1345 bp, Zea mays
  misc_feature (1)..(1345): Ceres cDNA ID no. 22005863
  misc_feature (1)..(1345): Ceres CLONE  ID no. 1565409
  misc_feature (1)..(1345): Also known as  Ceres CDNA ID no. 24386218
agtcgtcccactgcactcccaccgcccaagctttactacgtgatcgatccgatccgccgcggcgcgtaggaaaccatcctccccccgcgcctcgtgccatggccgtgcacgcgcagtaccacgcccacgccttcccacatgacctccgcgccatccccagctgcccagcgctggacaacgccacgagcgcgtcggcgttcctcgtcgccgacgccgaccccgcacccgcggctggcgtcaacacggcgctcagcggcctcacccgcaacggcatcagccacggcagaggttgcctcggcggcgcaaggaagcgcgcgcgtgtgactatggacatgcaactgcaaggccagcgcgctctgctgcccccggtgccgcaggcgttggcgtccgcggggggcgtgcagagcagggcgctctgctctggctccgcgtccaccagccagcgaccggctagcgccgcgccagtgtcgcagggcctcctcccgcacatctaccgccacagcgtcgagatcgacctgcttctccgcgtcgagactgagcggctgcaggcagggctccaggacgcgcggcgccggcacgcccgcgccgtgctgtccgcggtgggacgcggcgcggcgcggcgcctgagggcggcggaggccgggctggagcgcgcgctggcgcgcaacgcggagctcgacgacaggctccggcagacggtggccgaggggcaggcgtggcagggcgtcgccaggagccacgaggccgtcgccgcggggctacgcgccacgctcgacagcctcacgcaggcgcaggcgccatgcgctggcgagggcgagggcgagggcgacgccgaggacgcgcagtcgtgctgcttcgacctggtggagcaggaacagggagccgacgaggcgtccggcgggcggacgagggcgtgcaggtcgtgcggcgacgcggaggcgtgcgtgctgctgctgccgtgccggcacctgtgcctctgccgcgggtgcgaggcggcggccggcgaggcgtgccccgtgtgcgcggccaccaagaacggctcgctccacgtcctcctctcctgattcattcatccacggcccgtgccaccgcgttcgcttcgaattgaaggaggcatcacgaaacgagaaccaagtggaagaggcggaggacattgagcccatccatggccccaatagaaatgacgcgcgaaaatcattctgcttacacttcacacacagttcacagacagagggggcttcatgaagagagccacgatgaggcgctcaagcagaccaggaagggcacatgaagcgcgcgcgcaatggatgtgagcttgatctttacgagtaaaaaaaaaaaaaaa

SEQ ID NO: 5534 - protein, 321 aa, Zea mays
  misc_feature: GI Number: 50909081; NR Description: SBP1-like [Oryza sativa (japonica cultivar-group)] >gi|49388268|dbj|BAD25386.1| SBP1-like
  misc_feature: GI Number: 21593126; NR Description: inhibitor of
  misc_feature: GI Number: 50911595; NR Description: S-ribonuclease binding protein SBP1-like [Oryza sativa (japonica cultivar-group)] >gi|41052730|dbj|BAD07587.1| S-ribonuclease binding protein
  misc_feature: GI Number: 21617976; NR Description: unknown [Arabidopsis thaliana]
  misc_feature: GI Number: 50905017; NR Description: putative S-ribonuclease binding protein SBP1 [Oryza sativa (japonica cultivar-group)] >gi|41052555|dbj|BAD07737.1| putative S-ribonuclease binding
MAVHAQYHAHAFPHDLRAIPSCPALDNATSASAFLVADADPAPAAGVNTALSGLTRNGISHGRGCLGGARKRARVTMDMQLQGQRALLPPVPQALASAGGVQSRALCSGSASTSQRPASAAPVSQGLLPHIYRHSVEIDLLLRVETERLQAGLQDARRRHARAVLSAVGRGAARRLRAAEAGLERALARNAELDDRLRQTVAEGQAWQGVARSHEAVAAGLRATLDSLTQAQAPCAGEGEGEGDAEDAQSCCFDLVEQEQGADEASGGRTRACRSCGDAEACVLLLPCRHLCLCRGCEAAAGEACPVCAATKNGSLHVLLS

SEQ ID NO: 5535 - DNA, 2028 bp, Zea mays
  misc_feature (1)..(2028): Ceres cDNA ID no. 22005864
  misc_feature (1)..(2028): Ceres CLONE  ID no. 1566947
  misc_feature (1)..(2028): Also known as  Ceres CDNA ID no. 24386526
agcctccctcccggtcccggtcccggcctcccccctccccctccccctccgctccccccaaccccagaacatccggcgctttcaccccccaccggcccacccccttcccctcccctcgtcctccgcgatggcggcgtccatggcgtcgccgcgggggcggtcgatccgggagacggtgctggagaccgtggcggcgtaccaccagcagcagcgggccaaggggaagctgcgcaagagcctcacctacgccggaggcgagctctcgtccgcgggccgggcccgcggggacggccccgcctccacctccgtctcctcgctctgcgggcccgacgacgacgacgagcccttctgggaggaggaggagggcaccgtcgagctcgtccagctcggggccaaccgcgctaagaacgtcctcatcctcatgagcgacaccggcggcggccaccgcgcctccgccgaggccatcaaggacgccttccggatcgagttcggcgacgagtaccgggtcttcgtcaaggatctgtgcaaggaccacgccggctggccgctcaacaacatggagagctcctacaagttcatggtcaagcacgtgcagctctggaaggtggcattccacagcacctcgcctagatgggtccataacttctacctcgccgctctcgcctcattctacgccaagaaggtggaggctggactgaagaagtacaagccagacatcataattagtgttcatcccctcatgcaacacattcctctgtgggttctcaaatggcaaggcctacagaacagggtagtctttgtaactgtgatcacagacctcaacacatgccaccctacatggtttcatgctgatgtgaatagatgttactgtccttcagaagaagttgccaagcgggcagcactggatgatctacaaccatctcaaatccgcgtgttcggtcttccgattcgaccatctttctgtcgtgcagttcttgttaaggatgatttgaggagggaacttgaattggatcctgagcttcctgcagtactgctcatgggaggtggagagggcatgggtcctgtcaaaaagactgccagagccctaggagaatcattgtttgacaaagagcttggaaagccaattgggcagcttattgtcatttgtggccggaacaaaacgctaagctcctcactgcaggcagttgaatggaaaataccagtaaaggttaggggatttgaaacccaaatggagaagtggatgggagcttgtgattgcattataacaaaggctggaccaggtaccattgctgaagccttgataaggggtcttcctataatccttaatgacttcatacctggacaggaagttggcaacgtaccttatgttgtggacaatggtgcaggtgtgttctcgaaaagccccaaggaaactgctagtcttgttgcccgctggtttggtccagattcagaggaattgaaaaaaatgtcagaaaaggcactgaaattggcccaaccagaagctgtctttgacattgtcaaagacatgcatgagctctcccaggagcaaggtgtcatatcacagatatctagttccttgacttcatccttcttcttaccatcgcctgaaagcacccctctccaacttatctgaaaccatcaagctaggattgatattgttgacatcgtgaacttggcattctccctacagtgtgggcgtgctttcggctgatccgctcacatggtagttatgggcagggtcgtttgactgacaggttctcgcgtgtgatgatgtttgccttcatgttaacttttgtaaaaaaaaacattcattcatattatgtttctggctcccttcgtcatcaaaggggaattggtggtggtggtggcttgtaaaatacactcaaattttgtgcttggacatatcagacccttatcatgtatactagctgatgtgatccgttcatgtaagttgaagatgtgtataatatgattacagattgttggagttgaagtttctctcaaaaaaaacaaaaaaaaaaaaaaaaa

SEQ ID NO: 5536 - protein, 501 aa, Zea mays
  misc_feature: PFam Name: MGDG_synth; PFam Description:
  misc_feature: PFam Name: Glycos_transf_1; PFam Description: Glycosyl
  misc_feature: PFam Name: FH2; PFam Description: Formin Homology 2 Domain
  misc_feature: PFam Name: Pyr_redox_2; PFam Description: Pyridine
  misc_feature: PFam Name: Drf_FH1; PFam Description: Formin Homology Region 1
  misc_feature: GI Number: 25453505; NR Description: 1,2-diacylglycerol 3-beta-galactosyltransferase (EC 2.4.1.46) [imported] - Arabidopsis thaliana >gi|30687800|ref|NP_568394.2| 1,2-diacylglycerol
  misc_feature: GI Number: 18700258; NR Description: AT5g20410/F5O24_300 [Arabidopsis thaliana] >gi|13937145|gb|AAK50066.1|
  misc_feature: GI Number: 31711946; NR Description: At4g31780 [Arabidopsis thaliana] >gi|7270081|emb|CAB79896.1| monogalactosyldiacylglycerol synthase-like protein [Arabidopsis thaliana] >gi|3281850|emb|CAA19745.1|
  misc_feature: GI Number: 5912588; NR Description: MGDG synthase A [Spinacia
  misc_feature: GI Number: 9884651; NR Description: MGDG synthase type A
MAASMASPRGRSIRETVLETVAAYHQQQRAKGKLRKSLTYAGGELSSAGRARGDGPASTSVSSLCGPDDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHSTSPRWVHNFYLAALASFYAKKVEAGLKKYKPDIIISVHPLMQHIPLWVLKWQGLQNRVVFVTVITDLNTCHPTWFHADVNRCYCPSEEVAKRAALDDLQPSQIRVFGLPIRPSFCRAVLVKDDLRRELELDPELPAVLLMGGGEGMGPVKKTARALGESLFDKELGKPIGQLIVICGRNKTLSSSLQAVEWKIPVKVRGFETQMEKWMGACDCIITKAGPGTIAEALIRGLPIILNDFIPGQEVGNVPYVVDNGAGVFSKSPKETASLVARWFGPDSEELKKMSEKALKLAQPEAVFDIVKDMHELSQEQGVISQISSSLTSSFFLPSPESTPLQLI

SEQ ID NO: 5537 - DNA, 2124 bp, Zea mays
  misc_feature (1)..(2124): Ceres cDNA ID no. 22005865
  misc_feature (1)..(2124): Ceres CLONE  ID no. 1570298
  misc_feature (1)..(2124): Also known as  Ceres CDNA ID no. 23838990
agcgcgagcgccggcgcctacgccaggtgcccaggcctccgtcggtcatttcgccaggcattcgtcgcgggctcttcgccggcgacgagcacacccaccaagttgaggattggtcctttacgagcatgttataatgggagagaacggagttcagctgacactgacctccactttgaagagcacaggcaagccacggatcaatgcggacgggctgaataatggatcacatactaccaaagagaagcatgaacacggtggcactttccaaccatcaaaaggccagaagcagcagctgtgcacaacatgtgcaaaagggcatacttgtcaatcggtcatcaaccggacaagacaaatgcgagctctaatcgactcaaagaagccttaccaagcacactctgtattcaagcacttaatggatgaggggcacaagccttcattggtcacatacacaattctactgaccgccctgacgaaccagaggatgtttgagtcgattccatcactgcttgctgaagttgaactagctggagttagaccagactccatcttcttcaatgccttgataaatgcgtttgttgaggcgaagcggatgggcgaagcgataaacacattctggaaaatgaaacattctggctgccacccaactacaagcaccttcaacacactgataaaaggttatggcattgtaggcaaacccgaagaatcacagcgcgtcttcgacatgatgggcgttgaaggatcagtcaggcctaacctcacaacatacaacattcttgtgaaggcatggtgtgatcacagaaatcttgaggaggcctggggtgttgtgggcaaaatgcaagcaggtggttttgagcctgatattgtaacttacaataccatagccagtgcatatgccaataatgacgagacatggagagcagaagagctcattgtggagattcagactagagtgcgcaccagtgagcgaacatggggcataatcattggtggttattgccgggagggcaggttggaggaagcattacgatgcgtccagcaaatgaaggatgcaggaagtgttcctaacgtcgtcatcttcaacacactgctgaagggctttcttgatgcaaatgacatggctgctgtcaataagatcctgggtctgatgaagaaatttggcatcaaacctgacatcgttacctacagtcaccagttgaacacattcagctcgctgggccacatggctaaatgcatgcatgtatttgacaaaatgatcgaagcaggaattgagccagatcctcaggtatacagcattctcgccaaaggatttgttcgtgctcagcagcctgagaaagcagaagaccttctgttgcaaatgagccatcttggtctctgcccaaatgtcgtcactttcaccactgtcattagcgggtggtgcagcgtggccgacatggagagtgccatgagagtctatgacaagatgtgcaagtcaggcgtctatcccaatctcaggacatttgagactctgatctggggctacagcgaacagaagcagccatggaaagctgaggaagtccttcagatgatgcgggagactggtgtcaagccgaagcaaagcacctactgtctcattgctgatgcatggaaggctgttggtttgactgagaacatcaacaactcaaatggttcccccaatggtccttatgcaatcgagaaattggatcattcaaatgacaattgcaacgtgcgaatatcagaagacaataataacaagctgcagttttttgatgaaagtaatgggcgtgcaatgaatggccgttcacgttccagttttcttcagataacaaatgcactaggcagcagtggtatagtttctgccaaggtcatgaaggctggagaatttccatctgaaagactgaaggctatcaaaaacacatcctttccacaaggatttcaattgttgcatctcgagttttgtaggaagcagcttcggaagaatggtggattctgtagtcagagcatcaactcattcaaaatgggtttctctagcagaggatgcatttattaattcgatgtacacattgggctgaaacttaaacaaaaacaaatctcggtgttccaagtctccgccaaaaaaaaaaaaaa

SEQ ID NO: 5538 - protein, 637 aa, Zea mays
  misc_feature: PFam Name: PPR; PFam Description: PPR repeat
  misc_feature: GI Number: 34904258; NR Description: Ipomoea nil leaf protein like protein [Oryza sativa (japonica cultivar-group)] >gi|17385740|dbj|BAB78680.1| Ipomoea nil leaf protein like protein
  misc_feature: GI Number: 3107905; NR Description: leaf protein [Ipomoea nil]
  misc_feature: GI Number: 30689969; NR Description: pentatricopeptide (PPR)
  misc_feature: GI Number: 29294052; NR Description: protein kinase family
  misc_feature: GI Number: 42570531; NR Description: protein kinase family protein [Arabidopsis thaliana] >gi|19071860|dbj|BAB85674.1|
MGENGVQLTLTSTLKSTGKPRINADGLNNGSHTTKEKHEHGGTFQPSKGQKQQLCTTCAKGHTCQSVINRTRQMRALIDSKKPYQAHSVFKHLMDEGHKPSLVTYTILLTALTNQRMFESIPSLLAEVELAGVRPDSIFFNALINAFVEAKRMGEAINTFWKMKHSGCHPTTSTFNTLIKGYGIVGKPEESQRVFDMMGVEGSVRPNLTTYNILVKAWCDHRNLEEAWGVVGKMQAGGFEPDIVTYNTIASAYANNDETWRAEELIVEIQTRVRTSERTWGIIIGGYCREGRLEEALRCVQQMKDAGSVPNVVIFNTLLKGFLDANDMAAVNKILGLMKKFGIKPDIVTYSHQLNTFSSLGHMAKCMHVFDKMIEAGIEPDPQVYSILAKGFVRAQQPEKAEDLLLQMSHLGLCPNVVTFTTVISGWCSVADMESAMRVYDKMCKSGVYPNLRTFETLIWGYSEQKQPWKAEEVLQMMRETGVKPKQSTYCLIADAWKAVGLTENINNSNGSPNGPYAIEKLDHSNDNCNVRISEDNNNKLQFFDESNGRAMNGRSRSSFLQITNALGSSGIVSAKVMKAGEFPSERLKAIKNTSFPQGFQLLHLEFCRKQLRKNGGFCSQSINSFKMGFSSRGCIY

SEQ ID NO: 5539 - DNA, 1883 bp, Zea mays
  misc_feature (1)..(1883): Ceres cDNA ID no. 22005867
  misc_feature (1)..(1883): Ceres CLONE  ID no. 1571697
  misc_feature (1)..(1883): Also known as  Ceres CDNA ID no. 24386746
aaagttctctactgctctcgcgttcacgcgcgaagccgaaaaccctttcgcgccccgcccccgccccctccatctccacccgtctccctcttaccgccgtacacatccagcattcctccccccaaattctatgccatccacgaagtaaccgccgatttccctccccgcgagccacaagcccacaatgccgactctccgcagcgcgacggcgaacgcgtcccccatgggcaccccattacctgccgagacgagcacgccgcgcagcgtcaagcgccggctgacgccaggtcgagccggcgagtcgcctggcgcgtcgcggcacacctctcctcaccgacacccgcacgccagcaccggacctgtacacgtgcctaagatgctctcggcgtcgcccaagtcctccaggaagcgcctctacggtgacttcgtcgcagccgagaagcccaagtggaacccccgagatgccgcgcagatgagggctgtgaaggaggcgctgcacgtggcgacagtgccgtcgtctgaattggtttgccgggacaacgagctcaggcgtgtccttgagttctgcgaggcgtgcgtcgagcaggagaaggctggtagtctctatgtctgcgggtgccctggcacagggaagacattatctattaacaagatcaaggatagtttggtgtgctgggggaatgagacacctgatgccttaacaatcaattgtacaaacctagcaaacacctctgatatttttggcaagatgctagaaacatttcagaaccgaaagaagggacgcaacaaattgtcgccacttcaccaacttcagagcatgttttccaacaaggattcagctccaagaagaatgatgttggtcatcgtggatgagattgactacttaataacaagagaccgtgctgtgctgcatgatcttttcatgctcacaacttgtccattctctagatgcatactcataggaattgcaaatgccatagacttagcagatcgttttcttccaaagctggaatccttaaattgcaagcctcttgttgtgacttttcgagcatattctaaggatcaaatatctgacatagttaagcataggctaaaggttcttgagtatgatgtctttgaaccactagctctggagttttgtgctagaaaagttgcagctgcctctggtgacatgagaaaagccctaggcgtttgcaggagtgctgtggaggttcttgaagcaaggctacatgatttccctgataaagaattaagaatagtgacatttgaccatatggatatagctttgtcaaaagcattcaagtcagcagtcgtagatagcatactgtgtcttccccagcaccaacagatggtgctgtgtgcgctggcaaatacctttcagcattgcaagaaaaaggctactactctaggagagctgaacaaatcatacatcgagatttgtagatcaacccaagttccagcacttggaatgattgaattttctaacatgtgtatggttttgagtgatcaggggttcatgaagttggggcaatccaaggaagataagcttaggagagtaacacttcatattgacagttcagatatcacttttgcctttaagggaaatcgtttcttccaaaaatgcctggagcagcgatgctaaccagactcaatagtagatcaatacatgtagccaattgttgttatacactgtagtattagtttattgacattatcaagtaccatcagtttcaaccctggatgtatactcaggtgctttcatccaacatgatcaaaccttggttacatcacgaaactctttcttggagtgcagagataagtgtacatgtgacgagttatgacagtattacgtgacataatttttccaaaaaaaaaaaaaaaaa

SEQ ID NO: 5540 - protein, 485 aa, Zea mays
  misc_feature: PFam Name: AAA; PFam Description: ATPase family associated
  misc_feature: GI Number: 34908412; NR Description: putative CDC6 [Oryza sativa (japonica cultivar-group)] >gi|21743322|dbj|BAC03316.1|
  misc_feature: GI Number: 56785345; NR Description: putative cell division
  misc_feature: GI Number: 56785346; NR Description: putative cell division
  misc_feature: GI Number: 22795810; NR Description: putative cdc6-2 protein [Arabidopsis thaliana] >gi|18056482|emb|CAC83650.1| CDC6b protein [Arabidopsis thaliana] >gi|30680045|ref|NP_172207.2| cell division
  misc_feature: GI Number: 15384672; NR Description: putative CDC6 [Arabidopsis thaliana] >gi|18056480|emb|CAC81074.1| CDC6 protein [Arabidopsis thaliana] >gi|30684328|ref|NP_850137.1| cell division
MPTLRSATANASPMGTPLPAETSTPRSVKRRLTPGRAGESPGASRHTSPHRHPHASTGPVHVPKMLSASPKSSRKRLYGDFVAAEKPKWNPRDAAQMRAVKEALHVATVPSSELVCRDNELRRVLEFCEACVEQEKAGSLYVCGCPGTGKTLSINKIKDSLVCWGNETPDALTINCTNLANTSDIFGKMLETFQNRKKGRNKLSPLHQLQSMFSNKDSAPRRMMLVIVDEIDYLITRDRAVLHDLFMLTTCPFSRCILIGIANAIDLADRFLPKLESLNCKPLVVTFRAYSKDQISDIVKHRLKVLEYDVFEPLALEFCARKVAAASGDMRKALGVCRSAVEVLEARLHDFPDKELRIVTFDHMDIALSKAFKSAVVDSILCLPQHQQMVLCALANTFQHCKKKATTLGELNKSYIEICRSTQVPALGMIEFSNMCMVLSDQGFMKLGQSKEDKLRRVTLHIDSSDITFAFKGNRFFQKCLEQRC

SEQ ID NO: 5541 - DNA, 1971 bp, Zea mays
  misc_feature (1)..(1971): Ceres cDNA ID no. 22005868
  misc_feature (1)..(1971): Ceres CLONE  ID no. 1572076
  misc_feature (1)..(1971): Also known as  Ceres CDNA ID no. 24386768
aagcccaagcaggcttctccgactcccgtcccccattccgtccgccaccgccttccccctccctcgaatcattcgattcgcctcccgtcgtctcgtccgcctgattctactcggccgtcacggtgatcggagccggctagggttagggttccgtacttccgttgatctccacgcccatggtgcagctgccgagctccggtaagcggcacgcggaaccggccgagcagacgatggctccggcgcggcgcgcggcggcggtcaagctggaggtggaggagctcggggccaacgagcgcggcccgctcagcaagcgcgccaggccagctcagccgatgcccccgacgcctccgcagccgcagcaggatatgtaccacaatgtacttgatgaacctagcccattgggtctgcggctgaaaaaaagcccatcactcttggatttgattcagatgagactttctcaagcatccaacgctggggagtcttccatggacaacagtggttctgagccttccaagaagaaagacagtaaatccggtgtgtcttcagcaggcgaacggctaaaagcttcgaattttcctgcaaatatattgaagattggttcatgggagtatgtctcacggtatgaaggtgatttggtggcgaagtgttactttgcaaagcataaacttgtgtgggaagttctggaaggtggccttaaaagtaagatagaaattcaatggtcagatattgctgctttgaaggcaatttgccccgaaaatggccaaggaaccttggacgtggtgttggccaggccacctcttttctttaaagagacagatccgcagccaaggaaacacacactgtggcaggctgcctcagatttcactggtgggcaagcaagtatgcacaggcggcattttctgcagtgcccttcaaccttgttaagcaagaattttgagaagcttattcagtgtgatcagcggttatatcaattgagtcaacagccagagatcacattagaccctacattgtttgaacctaggtgcacaatatttgaggatccggttgaatcaaaatgcgctggttttactaatttgaaagatgaacatcgggctttgcctggctattcagattcggtgtcaccatgtgccggttcctccatatctgctaagaaagaaaacaatgattccataagaatgccagcagaatatcctcctcagacagtaggaataggagttggtgctgtaggtgcacaagctgtcagcagaaatgtgaatggtgcagcaccagaattcaatatccccaactggtggagtcaattgaaggtgcctgggcttagaccatccatgtcagtggatgatctggtcaaccacctaggcaactgcatctcagagcagatcacttcaggcgatccggcattggccaacaacgaggtgccaaccaaagaaacactcgaggggattgctcagtaccttcttggtgacacacaaggcccgccggttactgctgcagtcgagagatcactgatggccagggtggactccctctgctgtttgattcagaaagacacagcaccagttgccaaaccaaagcccgagccaaatgacggggacagcatcggcgtggaagcctcagatggttccgacgaagaattcacctccgcgccaacagggaaacctacagatgccaccaacccgccagccatgtcaagaaaggattcgtttggagagctgctgacaaacctcccccgcatcgcctcgctaccacagttcctcttcaagataccagagggtactgagaactgaacgtggaagttaagatccctggaataggtagtttgctgtaagcctgtaaagattgtatccaagcaataagaaagccccttatcacctcctcggaggcgtgttccccgctctgtaaatttgacaccggtaggttgctccagttgtatgttttgcgaatcatgggtagtggtaaaaaaaaaaaaaaaaa

SEQ ID NO: 5542 - protein, 535 aa, Zea mays
  misc_feature: GI Number: 28828403; NR Description: similar to Dictyostelium
MVQLPSSGKRHAEPAEQTMAPARRAAAVKLEVEELGANERGPLSKRARPAQPMPPTPPQPQQDMYHNVLDEPSPLGLRLKKSPSLLDLIQMRLSQASNAGESSMDNSGSEPSKKKDSKSGVSSAGERLKASNFPANILKIGSWEYVSRYEGDLVAKCYFAKHKLVWEVLEGGLKSKIEIQWSDIAALKAICPENGQGTLDVVLARPPLFFKETDPQPRKHTLWQAASDFTGGQASMHRRHFLQCPSTLLSKNFEKLIQCDQRLYQLSQQPEITLDPTLFEPRCTIFEDPVESKCAGFTNLKDEHRALPGYSDSVSPCAGSSISAKKENNDSIRMPAEYPPQTVGIGVGAVGAQAVSRNVNGAAPEFNIPNWWSQLKVPGLRPSMSVDDLVNHLGNCISEQITSGDPALANNEVPTKETLEGIAQYLLGDTQGPPVTAAVERSLMARVDSLCCLIQKDTAPVAKPKPEPNDGDSIGVEASDGSDEEFTSAPTGKPTDATNPPAMSRKDSFGELLTNLPRIASLPQFLFKIPEGTEN

SEQ ID NO: 5543 - DNA, 1995 bp, Zea mays
  misc_feature (1)..(1995): Ceres cDNA ID no. 22005869
  misc_feature (1)..(1995): Ceres CLONE  ID no. 1574416
  misc_feature (1)..(1995): Also known as  Ceres CDNA ID no. 24392219
aacgatgcgagtggcagcgcgcgagcgcccattcccgttcctcctcgcccatcggcttctcgcggtctcgccccggcacctcgcactcccaccgcagtccaaaatcctcggcctcacaccctatgcctccgcctgttcttcgcctgttcgcggcagctccgccccgcgctctcggtggccgcgccagggcgcatcgtggcgatggcgggttcgcgcgcctgcgcctgcgcgtcagagcagcggctggggaggccgcgccggcgccttccagaacccagatgataatggataagatctctgctggcgaaggagtcggaggcgctggaggggcttactcatatagtgcgttgaaaagattggatcaaatatggtctagtatttgtgaagctcaagcagattccaaagtccctgaagttgttactcgggttgaagggctgttggctgattctgatcttggttctggttcagagatatttgatgtaattgtatgtggcggcacattaggtatatttgtagctactgctctcagttctaaaggccttcggattggaattatcgaaagaaacataatcaaagggagggaacaggagtggaatatttcaagaaaggagcttatggaaattgtagagattggtattctttcagaagcagaacttgaacaaataatttcaagtgatttcaatcctaatagatgtggatttgaagataaaggtgaaatttgggtggagaacattcttaatcttggtgtttcgcctgctaaacttgttgagaacatgaaagaacgcttcatttcttcgggaggagcaatatttgaggagaaaagtctatcaagcatttatgtctatgatgatctcgctgcttttcctgctggttctggtcccaatgaccgtactacatacatgttcacttatgttgatccaacatttggaggcccaaagctagaagaacttttggaagtgttttgggatcttatgcctgcttaccaggatgtgcttcttcaaaatttggatataagaagagttatatttggaattttcccaacttatcgggatagccccttgccagctgcatttgaccgtatcttacaggttggcgatgctagtggaatacagtcacctgtttcttttggaggttttggaagcttgacgagacatcttggccgtttgtctagtggtatatgtgaagcagttgaaggtgatttcctggatgctcatagtttgcagctgctcaacccttacatgccaaacttaagtgcatcatggttgttccaacgagcgatgtcagtaaggccacatgtcaatgtttcaccaacctttatcaatgagcttctctttgctaattttcagtcaatgcagaaactaggggattcggtacttcggccatttctacaggatgtaatacagtttggacctcttgtgaaaactttggggctagtaatgatcactagaccacaaattttaccttccatatttaagcaggttggactgggagtcatccttgagtggtcaggccattttatgatgcttggttactacacattcctttctacctatattgatccgatcctgaggtcttgggtggaatccttgcccccacgggacaaatatcagtggaaacggtacctggaagcttggagatatggagccggtttagattaccgccaaggggaataaactgtttcactaaaaacacatgaaagtttcctcagaaacaaaattatgtatagatacatgaatatagcactgtcaggggaaagatgaatagagtacatatatgatctctgattgatttagttttccttttccagagcacaagattgaacatcaagtttagaatgtgtattatctagtttcacttgtaatttgcccactttactgaactgatggagtgaatatgtatagtactctagaatttcaaataatgctgaatggagctgagatgctcaatatttgttgatcaacgtatcaattatgtgaaataaaaaaaaaaaaaaaa

SEQ ID NO: 5544 - protein, 1995 aa, Zea mays
  misc_feature: PFam Name: DAO; PFam Description: FAD dependent oxidoreductase
  misc_feature: GI Number: 50945853; NR Description: Glycine/D-amino acid oxidases-like [Oryza sativa (japonica cultivar-group)] >gi|37573089|dbj|BAC98659.1| Glycine/D-amino acid oxidases-like
  misc_feature: GI Number: 46135210; NR Description: COG0675: Transposase and
  misc_feature: GI Number: 48894952; NR Description: COG0458: Carbamoylphosphate synthase large subunit (split gene in MJ)
  misc_feature: GI Number: 53765570; NR Description: COG0644: Dehydrogenases
  misc_feature: GI Number: 48893081; NR Description: COG0644: Dehydrogenases
AACGATGCGAGTGGCAGCGCGCGAGCGCCCATTCCCGTTCCTCCTCGCCCATCGGCTTCTCGCGGTCTCGCCCCGGCACCTCGCACTCCCACCGCAGTCCAAAATCCTCGGCCTCACACCCTATGCCTCCGCCTGTTCTTCGCCTGTTCGCGGCAGCTCCGCCCCGCGCTCTCGGTGGCCGCGCCAGGGCGCATCGTGGCGATGGCGGGTTCGCGCGCCTGCGCCTGCGCGTCAGAGCAGCGGCTGGGGAGGCCGCGCCGGCGCCTTCCAGAACCCAGATGATAATGGATAAGATCTCTGCTGGCGAAGGAGTCGGAGGCGCTGGAGGGGCTTACTCATATAGTGCGTTGAAAAGATTGGATCAAATATGGTCTAGTATTTGTGAAGCTCAAGCAGATTCCAAAGTCCCTGAAGTTGTTACTCGGGTTGAAGGGCTGTTGGCTGATTCTGATCTTGGTTCTGGTTCAGAGATATTTGATGTAATTGTATGTGGCGGCACATTAGGTATATTTGTAGCTACTGCTCTCAGTTCTAAAGGCCTTCGGATTGGAATTATCGAAAGAAACATAATCAAAGGGAGGGAACAGGAGTGGAATATTTCAAGAAAGGAGCTTATGGAAATTGTAGAGATTGGTATTCTTTCAGAAGCAGAACTTGAACAAATAATTTCAAGTGATTTCAATCCTAATAGATGTGGATTTGAAGATAAAGGTGAAATTTGGGTGGAGAACATTCTTAATCTTGGTGTTTCGCCTGCTAAACTTGTTGAGAACATGAAAGAACGCTTCATTTCTTCGGGAGGAGCAATATTTGAGGAGAAAAGTCTATCAAGCATTTATGTCTATGATGATCTCGCTGCTTTTCCTGCTGGTTCTGGTCCCAATGACCGTACTACATACATGTTCACTTATGTTGATCCAACATTTGGAGGCCCAAAGCTAGAAGAACTTTTGGAAGTGTTTTGGGATCTTATGCCTGCTTACCAGGATGTGCTTCTTCAAAATTTGGATATAAGAAGAGTTATATTTGGAATTTTCCCAACTTATCGGGATAGCCCCTTGCCAGCTGCATTTGACCGTATCTTACAGGTTGGCGATGCTAGTGGAATACAGTCACCTGTTTCTTTTGGAGGTTTTGGAAGCTTGACGAGACATCTTGGCCGTTTGTCTAGTGGTATATGTGAAGCAGTTGAAGGTGATTTCCTGGATGCTCATAGTTTGCAGCTGCTCAACCCTTACATGCCAAACTTAAGTGCATCATGGTTGTTCCAACGAGCGATGTCAGTAAGGCCACATGTCAATGTTTCACCAACCTTTATCAATGAGCTTCTCTTTGCTAATTTTCAGTCAATGCAGAAACTAGGGGATTCGGTACTTCGGCCATTTCTACAGGATGTAATACAGTTTGGACCTCTTGTGAAAACTTTGGGGCTAGTAATGATCACTAGACCACAAATTTTACCTTCCATATTTAAGCAGGTTGGACTGGGAGTCATCCTTGAGTGGTCAGGCCATTTTATGATGCTTGGTTACTACACATTCCTTTCTACCTATATTGATCCGATCCTGAGGTCTTGGGTGGAATCCTTGCCCCCACGGGACAAATATCAGTGGAAACGGTACCTGGAAGCTTGGAGATATGGAGCCGGTTTAGATTACCGCCAAGGGGAATAAACTGTTTCACTAAAAACACATGAAAGTTTCCTCAGAAACAAAATTATGTATAGATACATGAATATAGCACTGTCAGGGGAAAGATGAATAGAGTACATATATGATCTCTGATTGATTTAGTTTTCCTTTTCCAGAGCACAAGATTGAACATCAAGTTTAGAATGTGTATTATCTAGTTTCACTTGTAATTTGCCCACTTTACTGAACTGATGGAGTGAATATGTATAGTACTCTAGAATTTCAAATAATGCTGAATGGAGCTGAGATGCTCAATATTTGTTGATCAACGTATCAATTATGTGAAATAAAAAAAAAAAAAAAA
